United States Patent 7,745,391 (HUMAN THROMBOSPONDIN POLYPEPTIDE) - sequence listing, part 155

SEQ ID NO: 405216 - DNA, 1706 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagccacctgtgttccagccgggagtcaagctccgggacaaggagcggca

SEQ ID NO: 405217 - DNA, 1394 bp, Homo sapiens
  misc_feature (1387)..(1387): n is a, c, g, or t
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagtcgacgcggccgcgaatttagtagtagtagtagncggccgc

SEQ ID NO: 405218 - DNA, 1187 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctaagggcatcctgtatacagggagtcgaagtcttcttctgggggatactctagaacgccaccca

SEQ ID NO: 405219 - DNA, 1005 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405220 - DNA, 718 bp, Homo sapiens
gcccgggctcgcctcacctccccgcctgcttaagccctcccggagcgctcggggttcgacccccgagcacggcgggaggagggcgcccccctgcggcacagccacgtccacgaagcccctcccggggttctagaaagcggaggcctccgaaggaaagaccaagatgcagagagatgtctaaaaggtgccagaaggtgactatccagccctggtatcactgcctggtgatttcgtttctttgatcttcacgaatggcctcactggctgtgatttggacagaaatcagctgccacgtgcaacattctcccatgggaacatgtgtccgcagtacctatctcagagcccaaatccttcctgccccacagccttctcctgggacctgccttgggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaattttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405221 - DNA, 208 bp, Homo sapiens
gatactttttgtcgtgtctctgggaaaaagtggacaagcatccctctgggatcagagagcaaaggatgcatgtggccatcaggacacaggagacaggcccagaccaagggtgtttggggaagagtgggggaaggctgctctgctctgaagtgagctttctctgctatctctcctggcttcccagctccgggacaaggagcggcagatt

SEQ ID NO: 405222 - DNA, 708 bp, Homo sapiens
aggctggtcttgaaatcctggccctgtgatccacccaccttgatcttggctcactgcaacctgtgcttcccaggttcaagtgattcttctgattcagcctcctgaatagctgggattacaggtgtgtactaccacgaccagctaatttttgtatttttagtagagatggtgtttcaccatgttggaccaggctggtcttgaactcctgacctcaggtgatctgccctccttggcctcccaaagtgttgggattacaggcatgtgccatggcgcctggccccaagtttatttttaaattgttttatctgctgtttctcatgctataccagattttcttccccatggcttgctcctagagttcttttgtatcacatctgtatacctttttgggatttccagcatttgagatattaatcttaaattaatttggggggtttcaatcaattttagattgttcatggtaattgctagtgagcaaccaattaactctgttttattagtttcctcaatagcactatatgcagctgttgataaaataaatgtaaagttctaatttttgttttagctaaaggttgactgttagggataatatttatatttataggatccaattcatctttatcccgaaacggggactcgcttttttcccgcaactgggagtatccaccttaacttttgctccttggttgccacacccgcggttttgcg

SEQ ID NO: 405223 - DNA, 3675 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405224 - DNA, 4143 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405225 - DNA, 4068 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405226 - DNA, 4418 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccaggtgagtgagtgactgtgctactacatttgggtaaaaaatataaaatggcattttgtgactgtaaatggaattgaacaaacaaaagatggtttcagaaataattttggcaggatcagttaatccaaccagtctttaaagagcaagtgtgcctatctgtagtattccgaagtattttgactagtgaatatataaaccttaccattctaatttaaaaatggttttcactttcaaaaaaaacatcagtagactgcattaaaaatgggttttccaaacagattggagatcagtcctggtttttattttgttagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405227 - DNA, 3783 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagattggagatcagtcctggtttttattttgttagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405228 - DNA, 4599 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctgattgttttttgctatttaatagccactgcccagacacatatttaagagtttaatctttcagttgctatggcttatgaacaagctaaggttgaccataaaacatttgttggatgacgtggtttaaaatgatcaccacaaaaagggaccacaaaaaaaggaaggaaatgagcatggttggcgattggaagcaagggtaccagagggcacagtgtgctttggcatgcattttatacataaaatgaatggaacaaaaggtgccagaagtcccaggttacacaatcaggagcttagatactgcacacaaaaataattatctgggttaaaaaagtaaacatagggcagattctatatggcctatcatgtttcttcaccttcccctcgttgctggctgatacagcgaggtggtcagctgatgactacttagtcaatatgacctttagtcgtgaaactgacagcagcagtgattaaggctgacttaatcaggttggccactttgaaggacagaaatgcagtggaaacagttttattctatgtagtttacatgcttaaggttacagagtttctacctgcactgtaatggaaatataatttctctgtagccaaaagctggcaaacttgacccagagggaaaatttaaaactgcagcaggctcaaatgtagagtatttttctttttatgggcaggttgttcagggatttttttcctcctttaatttattgactgactgtaaatacatgagtagaaacttaatagtcatgtatttcaaaatttggcttaatttaggagaatccactgatgaacaagtaccaacttacgtttcaagcttcttagccccataatcagtccttcagccacagctatttagagctttaaaactaccaggttcaatcactggttatgctttctgtgatgtaatttagtcatt

SEQ ID NO: 405229 - DNA, 2826 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405230 - DNA, 3711 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaaaaaaaaaaaaaaaaaaaaaaaaaaacaaaaaaaaaaaaaaaaaaacaaaaaaaaaaaaaaaaaaaaaaacaaaaaaaaaaaccaaaccaaaaaacaaaaacacaaaaaaagacacagacaacaaaagaaaaaagaaccaaaaaaaaacaggccacgacgcgagcggccgcggcgtccccacactccaaatcacaagagaaccacgcgccccaacagcgacatcccgaccgacccgcaacacgagacgcgcactacggggccgacaaaaatactaaacagcacaacgacgccggacaccagccagacccgacgagccatgacagaatacgaccggccccacaaaacaccagccagaatgagaacatgcgcggcaaccagcgcaatacagaggaacgcaccaaagcaaacctcaaaccaaacagaccaccccgcagacggacgcaacacacccaaaaagcacagaacacacagacccaaacccacagacgcacgaacgacagccagcacacagagaaaatacgacaaccgcgcacaccccagccacggcccaa

SEQ ID NO: 405231 - DNA, 3995 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405232 - DNA, 3332 bp, Homo sapiens
aatagggtttactggaagaggagctatacagatggtacttagaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405233 - DNA, 2939 bp, Homo sapiens
aatagggtttactggaagaggagctatacagatggtacttagaggatgtagggccctacgtattagggcttcttagttgtagcgaagagcaattggtctggtacgtttagctttttcacatttagttttgaattctgactctagaaatgtacaaccccatcttttgaattacaggttttaagatgttatttgctcttaatacgtcttaaggtaacagccttgatcactgcttttactttcgatgaaataacttaatgagctgtgaagaaaaaattatcagattttaagggagagaattttatgaaaatgtctttgaggttcctgtcacctttatgagaatgtcttcaaagtttccatcaccacctctaccaatttttcttccaccggagccagtggacttaggttccataacaagctcctcttgttcactgaatgagctagacaatatttcccaccttttaaggaaaatatcagctgatatcaatgaaattaaaggaatgaaagcagctattttgacagtggaagcaaatctttttgatctaaatgttagagtgtccaagaatgaagcaaaaatttcatctttggaggttaaaatgaatgaatattcaacaacatatgaatgcaacagacagtttgaagatcaagaagaagatactgaatcacagtcaagaactactgatgtaaaaataatcggcttccttagaaacgttgagaaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405234 - DNA, 1621 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggtgatctgtcctttctctctggctgctttcaagatcttctctttgtgtttgatgttctgcagtttcactacgatgtgtctaggcgtggatttccttttatttttcctgtttggtataatgtatggaagcatcccatatatttgaaataaaatgcattatgaaatacat

SEQ ID NO: 405235 - DNA, 331 bp, Homo sapiens
ataccagattttcttccccatggcttgctcctagagttcttttgtatcacatctgtatacctttttgggatttccagcatttgagatattaatcttaaattaatttggggggtttcaatcaattttagattgttcatggtaattgctagtgagcaaccaattaactctgttttattagtttcctcaatagcactatatgcagctgttgataaaataaatgtaaagttctaatttttgttttagctaaaggttgactgttagggataatatttatatttatagtatttatttatttatttattttgatacggtgtctcactctgtcgcccag

SEQ ID NO: 405236 - DNA, 198 bp, Homo sapiens
gtacaagaccggactgcacattctaccatcccaccattaatgtcccaccacgacatgccttgaaatggattcgacctcaaaccaggtaaacattcaaattcgtttttctcatgtcagttcaaattcttttttctaatttgcagtttctaaatttataagcacacaaaattggaaactagactgttactttgaattttt

SEQ ID NO: 405237 - DNA, 4110 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405238 - DNA, 3750 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405239 - DNA, 4143 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagattggagatcagtcctggtttttattttgttagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405240 - DNA, 4169 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgtatttgaaatacctgtggaatgaagagaaaaaaattaaagctaagccatcttgtccaatatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405241 - DNA, 3345 bp, Homo sapiens
aggctggtcttgaaatcctggccctgtgatccacccaccttgatcttggctcactgcaacctgtgcttcccaggttcaagtgattcttctgattcagcctcctgaatagctgggattacaggctggagtgcagtggcatgatcttggctccctacatcctccacctcccgggttcaaagacagggtttcaccatattggccaggctggtctcgaaatcctgaccttgtgatccgcccacttcggccttccaaagtgctaggattacagatgatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405242 - DNA, 2901 bp, Homo sapiens
agaggatccccgacggatagcggatctgcaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagattactatgacatggaatccatggtccatgcagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctga

SEQ ID NO: 405243 - DNA, 3155 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatgtattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggcagtttaatttggtcctgagaatgttgcagtctttattaccccttttgcattaatccacttttctaaccaccttttaagctttaatttttaacactatacaccaagtctttgaaatcagtgatctgttatttaactctaaagcatttgacacttcttgccttaacagttttaaaaaccacacacaaaa

SEQ ID NO: 405244 - DNA, 2608 bp, Homo sapiens
atgcgcgttcactccggcgcggagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccggagtgccattaaggggaaattacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccattcctagcgcgagacctgaaaaaagagattccagagtttctacaagttcgcaggagtcaaaaaccacaaatgtcagacagacttacgatgatggagctgcaacccgactaatgtcaacagtgaaacctttgagggagccagcaccctctgaagatgtgattgatattaagccagaaccagatgatctcattgacgaagacctcaactttgtgcaggagaatcccttatctcagaaaaaacctacagtgacacttacatatggttcttctcgcccttctattgaaatttatcgaccacctgcaagtagaaatgcagatagtggtgttcatttaaacaggttgcaatttcaacagcagcagaatagtattcatgctgccaagcagcttgatatgcagagtagttgggtatatgaaacaggacgtttgtgtgaaccagaggtgcttaacagcttagaagaaacgtatagtccgttctttagaaacaactcggagaaaatgagtatggaggatgaaaactttcggaagagaaagttgcctgtggtaagttcagttgttaaagtaaaaaaattcaatcatgatggagaagaggaggaagaagatgatgattacgggtctcgaacaggaagcatctccagcagtgtgtctgtgcctgcaaagcctgaaaggagaccttctcttccaccttctaaacaagctaacaagaatctgattttgaaggctatatctgaagctcaagaatccgtaacaaaaacaactaactactctacagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggaactcaacagaggcaattattatcccgactgcaaatcgacccagtaatggcagaaactctgcagatgagtcaagacacaagatcatttattctgaagaagccaaagctgtctgaggaagtagtagtggcaccaaaccaagagtcggggatgaagactgcagattcccttcgggtactttcaggacaccttatgcagacacgagatcttgtacaaccagataaacctgcaagtcccaagtttatagtgacgctggatggtgtccccagccccccaggatacatgtcagatcaagaggaggacatgtgctttgaaggaatgaaacccgtaaaccaaactgcagcctcaaacaagggactcagaggtctcctccacccacagcagttgcacttgctgagcaggcagcttgaggacccaaatggtagcttttctaacgctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagcagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcccaccattaatgtcccaccacgacatgccttgaaatggattcgacctcaaaccagcgaatagcacccagtcctgcctggcagaagatcatgcagtttggaagttttcatgtactgatgaaagatactctacagaacttgtcaaatctttgaaacttggaatatattgctttcataatatgaaaaaaaaaaaaaaaaaaggggggggcaaaatcccggggcaagtagtaccaggtttgaaagggcccagggggtttaaaaagaggggggaaaagggcgagaagggggatggggagcttgggggagcacccagaagggaa

SEQ ID NO: 405245 - DNA, 303 bp, Homo sapiens
aaggttgtcaggggaagctttactgatgaggtgacttgagtgaagacctaaagaaggtaagggaggcagtcatgcaaagagctgattgaggaacattccagcctgggtgacagagcgagactccgtctcaaaaaacaacaacaacaacaacaacaacaaaaacaatcagccggctgtgctggtgcacacctgtaactcccagctacttgggaggttaaggcaggagaatcgcttgaacccgggaggcggatgttgcagcgagccaagatctgtcgtgagcagaaatcctgttttattaaaata

SEQ ID NO: 405246 - DNA, 509 bp, Homo sapiens
acgttgacagtttgaaagttggacttctagctctactgcgtagacttgtggttagagttcagtgagctgatgtgtaaagagtgtttcgctcaatgtctagaagtccaaaagcacctagtaaatgccagctgctgttttactggcaaagtctctaattaaagttctaaatagacgggtgtgaaggtgagtaacaagggccatattgaataagttgctcagtatctgcttgtttaggactttgcatgttactgaatgtaatatgtaaaagtttaaaaaatagtctaataacaagactccaattgtttatctctacaaagaccaagtttcagaatattaacagagtgttgggccgtgatcctttctgaatcagggccccttggagaaagctgtgcacgagttcctggtagggtatttagcccgtgaagggcaagtaatatcagtcttgaatgacagagttatctgcccaatttggacccctcagtggtccaaatggaagaaggtgtcagaca

SEQ ID NO: 405247 - DNA, 468 bp, Homo sapiens
aagaaaataaatcaatagaaatagactcaggaattatagacatggcgaaattagcagacaaagatggtaaagcagtcattatatgctccatgtgcgaacacagaggcaaacgtgaacatgatgagaaaaatggaagatataaaaaaatcttcctagtctccagtcttcaggcaagagcaatatgactactgtgtttctgtagcctgctggaacatctaggcagaatgtggctgtactgccctgctaccaacattctccatggagttgggagaggaacgaagtaccctgcagagaactgaatgtacactgggagctgctgagatgtggctggtctggggccagacagctgagcaggatcagttcagaaatgagggaaaactgtggatgttcctttaaaaagcacatcattattggtggccttgtgcccttaattctggttcgcacacagaacaagtgacaatttccatg

SEQ ID NO: 405248 - DNA, 670 bp, Homo sapiens
ctgctcttcaaaaatggagctggccctttaaatatttttcttttggtagttggtgcaatgctaggctctgtcaggagggggagctagagacattggaggaggaagaggccttcctttctggttgtgctgggctcatcttaacagcacagagctcacagcttctccaacatcaccctcccgcagtgcaggcaacttttccagaacaggaatcctgcagaggatggtggtcagtagcacttggcaactagcagcttctcctagtgcccccacaaataggtgtgcctctaatcagacactgttccatgacagctttccctggcacccaagggcagacttctagaacattctcccagacttctctgccattgtgaggcacagccatgcccttcccagcaacatctggatctcagctggggatagagcctgggggtgttctttcttagttctaggggtgctggctgctccttatgtccattattcctatattctttaaagctctcctgacttcttaccactccttcattactccaatcccctgttctagttagtacttatattaatcttctcatattcaaattgttatgtggtttctgtctcccaagtggatcatgactaatgcagaaatcaaattaagaggctgggcttatgtctgtggccccagaaatacagg

SEQ ID NO: 405249 - DNA, 611 bp, Homo sapiens
ggattagtagatagtaacttatccaaggtcacatcactagcaaaagacaaaacttggtattaaactcaggcattagctccagagcctgtgcacggaactgccatacaatactgccatgcgcatatatgaataagcctgagaatctgagaaagaaggagatgtgacctacctaaggccactcaactagttagttgtcccatataccatttgttttggtggttggaccagatctagtatgctcacagcaaatgaagaattttaaaatttccattttatagatgtagctcagttctagtaataatgatgatgacagtaacgacaacagcagtggcaactaatatttactaaacatctgttttggctgagcaccgtaatagctactttatgtatacactcatttattcatttatggaaacactgtttatggagagccttctatacacaaacaagtgtgttcacacaaaagcttgtacaccagtcgtttacagcagtattgttcataatagcctaaaggtggaccacttccaaatgtccatcaattagtgaatgaatacctgacatctggtatattcatgcactaaaatataatacaggcattaaaagattgaata

SEQ ID NO: 405250 - DNA, 476 bp, Homo sapiens
tgctctctgcctgaaacactctactttcttttcccttgctctttgaccctctctcaactggctaattcatactaacactttaggccccagtttattcaatacttcctccaagaagcgttcctcacttcctaaatctgggtatatgtgccaccctcactgcctatattcccattacaccctgaactcccccatcagaatactgtttactggtctatacctcacactgtattttatgttttctttggggaaggggtgtatctctattaccattgtaactccattcccagaatcgagcacaatgcctggcatagaagagatgctcaatcactatatgttgagtaaatgaaaaaaccttaaacaaaggttgctaatagcattatgtctctaataccagccagggcagaaagaaatgcatcccagacctacttgccaactgtcctcttcctcacaattctgatgcctctgcctggaccagt

SEQ ID NO: 405251 - DNA, 229 bp, Homo sapiens
ggcataagccaccaggcccagcctttctttctttttaaaattaatctttgtttaaaaatactctcattttttatttaattgtagcactcctagatcccgaaagcagatacactcttgttatgggtctgattcttttcattgcttcacgccttagaggatattgtccaatactggataaaagtttactcaggtctacttccactttaacggggatggctgaatatctctt

SEQ ID NO: 405252 - DNA, 407 bp, Homo sapiens
agaggctagcacaatgctgagctcaaaaactagttgttgaatttcagtaaaagtaagtagagcatttttcccaacattaaaagttagtgggcatgagatgacattcttttggtctactgggaaaagggtatctgactaaaagttagaaacacttttattttgcataaaaatgtaacattaaaacacagaaggaaaaagaaaatgaattcactgaattcatttgtcttttccattggttcgttgtcaatgtctgatgtcctggccataatggaaaaaacagttggcataaaagacatgggttgagactggctctgtcatttaatattgggttctgaaaaaaggccaatcctgagttgtagctttctctctgtaaaatggagttaatattactctagattatgatgaag

SEQ ID NO: 405253 - DNA, 355 bp, Homo sapiens
ttggaggtatgtactttattttagagacagggtcttgctttgtcacccaggctggagtgtagtggcacagtcatagctcactgcagccttgaactcctgggctccagtgatcctcttgccttagcctcccaaagcaatgggatcgtacaggtgagccattgcacctggccatgtatgtacattttttataagcattcagttgtttccaatagtctaatacattttgtatggccttcttatttttcatgaaaccttactacccattttaagaaatttgtaatatagaagaaaacagaagtttcaattgtggggtaagtaaagaaagatgatcaaagatgatttgaccaaaagagtt

SEQ ID NO: 405254 - DNA, 407 bp, Homo sapiens
ttattacattcgaagcagtttctaagtatcttcattcaatcacttaacaagtatttattaaatatatactgtgtatcagctattgtactgggctaagtcacagtgataaacaaaagaaacatagtccccaccccgtgcagtggctcatgcctgtaatcccagcactttgagagggcagatcacttgaggtcgggagttcaaaaccagcctggccaacatggtaaaaccccatctctacaaaaaatacaaaaaattagccgggtgtggtgggagacgcctgtaatcccagctacttgggagcctgaggtatgagaattgcttgaacccaggaagcaaaagttgcagtgagctgtggtggtaccaatactgtactccagactgggcaaaagagtaagactccaactcca

SEQ ID NO: 405255 - DNA, 272 bp, Homo sapiens
gcagacagctgcattgcccccttggtatgccgttgctgtcaggtcctcatctctatcgtacagtcattctctctgtctcgtacagtcactctctcagccatattcgtccctcagcagttcatcatgcttattactgtctatttaaaaaagaatcctccatttacttgtcagccacttccattttcaccctctttgtttcctgtttctaatcaaactgctcagaactgtctatacttaaacactattttctcaaatgctcacttctcagcccg

SEQ ID NO: 405256 - DNA, 105 bp, Homo sapiens
aaacagtttgtcgttggtcgttatgtcagaagaggagtgtattcctggaagaaggcccacaaaatatacccagagcccaggtgcctttctaagacgaatcaacat

SEQ ID NO: 405257 - DNA, 647 bp, Homo sapiens
atttctggaagtatgttaaaagcccatggaaattcatgagaaaatctggtataaccaaaagctgaatgggggtgaagctggatgtcaagagaactgggctctgagcccagcattaagtagataatatgctcccaggacaagccaccctaccactgtgaagtctctttttcctcacaaaataagaaactatacttgactgaaaaaaggtttctcaaggcccttaaaatgtggtgactctacatgtggttcagtaagagtcaaggccgggcaaaaaggcctgggaaacttccggtggaatacctgtatgcatcttagtcaaccactcttgaatatcatagggaagccaatcctcttgtttattgacaatcattcctctgagctatgtgtacaaaggagaatggaaagtagagatagataggaagaaagaaagaaatgaaggactgcatttaccacttggttttccaattttttgatttaagtggcaaaattgcttctgagcccctaaaccaccatttacccaactatattcactcacaggtctcccccagaggtttcttttgacttcatgccccgtgtctgggaatgtagctgaagaaagcatgcatctggataaagacacgaggagaacctgtgtgagactaattgct

SEQ ID NO: 405258 - DNA, 488 bp, Homo sapiens
tgagagcctggcaacagcgtctgattgctgcccgtcagcagcttcaccgcgagctaatctggactgcagtccgacctcccgggctccctcatgctccacgtgattgccatggtcaggaaggcaggaagcaaaaaatgcagctcaccatccagacgccctgcctcgtgctcccgcggactggctgcgccccagactcgggtttcagtagaatcaggatgagcctgctgggcagccgggtcacaggcccctaactcacctgcagacccacgcagatcagtcttcgcagtgagctcagggcagacctcagctttgctcaagcccggccctgccacaaacatgcctcacctcctgccacctaccctggccgttcctccagccaactgggcatgagaatgaaaactcccacaagttccatgggaatgcatatttgatgaactggaaaaatatcaggctaactaaataaaagttggatttccctgagcctcact

SEQ ID NO: 405259 - DNA, 453 bp, Homo sapiens
gaccctttcagtgaatgggaggtcctggggtctcagatattatcattaggcaggttgatgaaagtgtatgagttaagatgttaaatttataatgacccagaatgataaaattaagaaacttttttaggatatttagatacttagaagttagaccaaatataggtgcatgtgactggaaggatttagagtagagaaaaacctaagaaggaattctggaagaatatgtttccattttgaaaggtacattatatcttaccagctaccaatcaacttttttttttcctttgttttctttattttttgagacagggtctcgctcttttgcctaggttgaagtgcagtggcatgatcatggcttactgcagccttgacctcttgggctcaagtgatcctaccacctcagctcctgagtatctgggactacgggagtgctccactacatccagctaatta

SEQ ID NO: 405260 - DNA, 564 bp, Homo sapiens
ttctttcagatcttaagaaggactgtcacagcactgctgacctttgcgagatactagaccatactagaaacaagtacagaggagttatgagaaggaacgtccactattttcacctttccctatagatgactccatattaaacatagtccttcctgtcttctttctctgacttgaaaagtcacttttctttttcttttcttttttttttttttttgagcagtctcacaaaccccctttcccatgtctttctaggtttattttccttttctatatttgaatcttcctaaaacctgtttcttggaatatacatatatatatgtgtgtgtgtgtatatatatatatgtgtgtgtgtgtgtgtgtgtatatgtgtgtgtgtgtgtatatatatatgtataagagtgtgtacctatgaatgtgtacagatgtcttggctaaacggtagtataaatggcaagaatcatatgttacccaagctgcctgaagttttctagttacaaataaactctaaaatttctaaaccattaggagcatcactactataaaatcatctgttcacgtgcattt

SEQ ID NO: 405261 - DNA, 285 bp, Homo sapiens
ccaaagctgggggggttggttctcttttcattctcctggtttggggggtgtggggagaaatatgtggataatggcaaaccaggcaaggaggaatctaaccagaaagtctttatcaataaccttccacaccacaggttattaataaaattcaccaaggatggaagaagattttgttacggtggagagctggcttagaaaagaggaataaaagggaagaaataaatagagtagacagatataatccatccttctgcacatttaaaatcccaagaaggacagtccaga

SEQ ID NO: 405262 - DNA, 621 bp, Homo sapiens
aggacacagcaagaagtcatgctctatgagaaagctggctctcaccagacaccagatctgctggcaccttgatcttggacttctcagacttcaaaactgaaaaaaaatgtttaaatattagaacctacatttataaaatgcatggcccagaaatgttcctgactattgttattgaaaatgagagaaaacaagttacaattcaagggatataaaacagactggaaggatattcaccaacatgttggcaatgtttgtctctgggaagtagaacaattaataggacacggtggttcacacctgtaatcccagcaacttgggaggctgaagtgggcagatcacctgaggtcaagagttcaagaccagcctggccaacgtggcaaaaccccatttctacttaaaatacaaaaaaaattagccaggcatggtggtgtgtgcctgtaatcccagctacttgggaggctgaggcaggagaatcacttgaacactggagatagaggttgcagtgagccgagatcacaccattgcactcttgcctgggcgacaagagcaaaactctgtctcaaaaaaaatttttttttaatttttaaaaattaaataaataaataaacccatttccaaact

SEQ ID NO: 405263 - DNA, 390 bp, Homo sapiens
gctgcagtgtcgaattttaccaagattatttcaaagcacagaattttaaagtatctatttttaaactgcaggatctcttctgcctacttaataagatgggtaccagaacaaggttttgaaactgcatcagaaaatagaaacttacgaaaatgacaatgtaatatttgacatattttattgtataggcactattataaactgcaaaggccatacaaatggaggctactgttatgatctgacagaggaactctggactagcacaatccttcgccaaacatctcctctcttgcagtcagcatcggagaacccagttcccacaccaagtgtaacaaccaacacagactctgattctgcagcagacctacacccctccaacagctgtagcgtgct

SEQ ID NO: 405264 - DNA, 181 bp, Homo sapiens
ctccgtgtccccaacaaatctcatctcaaattgtaatcgccgcatgtcaggggagggacctggtgggaggtgatttcctccatggctgtttctcccatgctgttctcatgagagtgggatagctctcatgaaatctgatggtttaaaagtgtttggcagccaggcccagtggctcatgtct

SEQ ID NO: 405265 - DNA, 434 bp, Homo sapiens
gtttgaatgcaactaactgctcatcagttgacatgtattcacctggaacatatatccatcttataaatgttgattccagatctcaagtactgtatgtctttagttaattctagtgtattatttctggtgcttcttgttcttgcatggtcaaaacacagtgttttaaaaattttggctgggcgcagtagctcacccctgtaatcttagccctttgggaggctgaggcaggtgaatcacctaaggtcaggagttcaagaccagcttggctaacctggtgaaaccccatcgctactaaaaatacaaaaattagccaggcgtggcggcaggtgcctgtaatcccagctacttgagaggctgaggcaggagaatcgcttgaacctgggaggcagaagttgtagtgagctgagatcacgccattacactccagcctgggc

SEQ ID NO: 405266 - DNA, 183 bp, Homo sapiens
acgggtctgcaatagaagggggtggatacccccttccaccccatggagaagaaaagcaggaaaaagtgtggggccagtgggtcccttagggcaaaagtcctagtggcggcagctttcttgtctagaccctggttcgcgcagcgcgtgtcgcactcacccgtggagggtgggagacagcggccg

SEQ ID NO: 405267 - DNA, 464 bp, Homo sapiens
atgcataacatatacaaataagtaagtatatataatatatgtatatatcatttaagagtatatgtagctggaacctttgcgtcttttgagagagattaatgcctggagtggtactcattcaacaagtaggaacaaaatttgtttgaagtccaagtccaattaagaacaaatctgaggctgggcaccatagctcacgcctgtaatcccagcaccttggggggccgaggtgggtggatcacctaggttgggagtttgagaccagcctgttgaacatggaggaaaccctgtctctactaaagatacaaaattagcctggcatggtggcacatgcctgtaatcccagccactcggtaggctgaggcaggagaattgcttgaacctgggaggcggaggttgcagtgagctgagatcacgccattgcgcctccagcctgggcaacgagcaaaactctgtctcaaaaaaaa

SEQ ID NO: 405268 - DNA, 339 bp, Homo sapiens
tgctctatcttctgtttctaatctttgaataagctcaaaagtattttttaaatttccttatcttcctattgtttcataatttccatttctttgctgaggttccacatctcttcattcattgttagaatattttcctttacccccatgaacagatttataatagctgcctttaaacatcttgaattacaacaccttgaatatcttaggatcacttctactatcttcttgttaaattatgtatggatcccattttcatgtttcttcacacatctcatgaattttaaagttgtgtactaaaactgtaaggaattataaagatgctcaattctgttgtgtaac

SEQ ID NO: 405269 - DNA, 428 bp, Homo sapiens
tttccatttatttgtgtcttcttcaatttttacatcagtgttttatagtttccagtttgcaggtaatttactttccttagttaaatttatttctaagtgttttattttttcactattataaatggaattgttttcttgattacttttttagatagttcattgttagtgtatagaaacactattaatttttgtatgttggttttgtgtcctgcaaagttactgaatttgtttattagttctgtttgcagatgacaggatcttatatgtagaaaaattctaaagattccattaaaaaataattgtgcactgccaaaaggtgttattgttgttgttgttgttgtttttaagacaggcttttactctgtctcaaaaaaagaagagagaaaatgggcaagagatttgaacagacacttcaccaaagaagatat

SEQ ID NO: 405270 - DNA, 442 bp, Homo sapiens
acaggtttgaatgaaatttaatttttgttagaaccagaagctacagagagatcatctaactctgtagtccataaaatttgtggatcttaaccactaatttcttatttcattttaaaaataactttattaaggtataattcacataccataaaattttgtcttttaaactgtagaattcattagtttttagtatactcacaaggttgtgcaggcaggcgtggtggttcacgcccgtattagtagcacctttggaggccaaggcaggaggatctcttgagcccaggagtttgagaccagcttgggcaacatagaccctatctcttaaaaaaaaaaaaaaacagctgggcatggtggtatgcttctgtagtcccagcatactagggaggctgaggcaggaggattttttgagctttgagcccaggagatcgaggctgcagtgcta

SEQ ID NO: 405271 - DNA, 1341 bp, Homo sapiens
gaactcctgacttcaggtgatgcccgcctgggcctcccgaagtgctgggattacaggtgtgagccactacactcagcctaggaattctaaatcttgaaacaaaaccttgaagtacaccaaaatagagccttcttaaaacctaaatcttacagggcctatacaataacacaatgaaaaaacaacaaaatcaaagtattcaagcaacaactagcatgatgaatagaatagtacctcacatctcaaatactacgttggatgtaaatggcctaaatgctcctcttaaaagatacatttggaccaccaaccaagaatctgctgtgttcaggagactcacgtaacacataaggactcacataaacttaaggtaaaggggtgggaaaagatattccatgcaaatggaaaccaaaagcaagcaggactagctattcttatatcagacaaaacagactttaaagcaacaacagttaaaaaagacaaagagggacattacatactagtaaaatgattagtccaacaagaaatgtcataatccaaaatatatatgcacctaccaccagagcttccaaatttataaaaccattactactagacctaagaaattagacagatggcaacacaataatagggggtgacttcaatactccactgacagccctagacgggtcatcaagacagaaagtcacaaagaaacaatggagcttaaactataccttagaacaaatggacttaacagatacctacgggaacattctaccccaaaaactgcagaataatacattattttcaccagcacacggagcattctcaaggatagaccatatggtaggccacaaaacaagtctcgaataaacttaagaaaactgaaattgtatcaagtaccctctcacaccacagtggaatacaattggaaattaactccaaaaggaaccctcaaaactatatacaaatacatggaaatttaataatctgctcttgaatgatctttgtgtcaacaatgaaatcaagatggaaattaaaattttttgaactgaacaatagtgacacaacccatcaaaacctctgggatacagcaaaagcggcactacatttagtaagttcacagcattaaatgtctacatcaaaaagtctgaaagagcataaacagacaatctaagctcacacctcaaggaactagagaaacaagaacaaatcaaactcaaacccagcagaagaaaagaaataacaaatatcagagcagaactaaataaaactgaagcaaacactacaaaagataaatgaaacaaaaagctggttctgtggaaaaataaagaaaatcggtagaccattagcaagattaaccaa

SEQ ID NO: 405272 - DNA, 473 bp, Homo sapiens
attctgaatttattttcacagattcttaaagattgctcactttccctggatattgctttctgcttattattctttaaaacttaattggaagcaagcagccaaatcaaatctaacgaggctaagtaagcctatatttcttcaatagccagtgagaaaataaggttcaagatactaattcatttcagtgattttaaggaattaaatgatatttagacatttgtttcctgatttaaaaaatgactgagtgatttttaagccatctgaaattctgaggcaggcagtcacatttgatagacacgtttttagcatagttgaaagtttctctctttgtgaatcaaattgtcatactgaatataatgtaactacttttttatgtctcagggtcattatgaaaaatgattttaatactgagcttatggaaatgccctaaaactttttgtgtttagaacattaaaaatgcctggcaatgtgtg

SEQ ID NO: 405273 - DNA, 358 bp, Homo sapiens
gggctggcattgccctcaacaaccactgtgtcaagctcatttcctggtatgagaatgaatttggctacagcaacagggtggtggacgtcatggcccacaagtcctccaaggagtaagacccctgaaccaccagccccagtgacagcacaagaggaaaagagaggccctcactgctggggagtccctgccacactcagtcccctgccacaatgagaatctcccctcctcacagtttccatgcagaccccctgaagagggagtggcctagggagccccaccttgtcttgtaccatcaacaaagtcccctgtgctcagccaaaaaaataaatacataaaatttttttctataaagttaaaa

SEQ ID NO: 405274 - DNA, 365 bp, Homo sapiens
tttagcctgaaggacttcctttactatatcttacacaagagatttgctagtgacacattctttcagtttttgtttatctgacagtcttaatttttccttcatctttaaagttagttttgctggacatacactcttgattgacagttgttttcattcagtactttgaatatgtcatcccattgcctctggcttccatggatcctgatgagaaattggctgttaatctattaggcatcatttgcaatgcagcttctactttgctgctttaaagattttctgtttgttttggctatcagcagtttaattattttatttctagaagtggctcttttttagtttatcctatatgatgtcattgatattct

SEQ ID NO: 405275 - DNA, 419 bp, Homo sapiens
taaatgaaaaaactgaggtctagaaaggttaaataatttcccagaattcatatagtgagtatatggaggagccagaatttgctattctgcctttttgcactataaaaagtttgcgaagattggtagaccccagaaaggatggagtaattggctctaccttagaaaatcaaacagcatcacagaagagatggcactggagcatcttaagggacaggtctaagatagccagatgaattggaactgtgagcatttccagctgagggagcagtttctgcaaagccaaggaaacccgagagcaacatatgttccacagactacaaatagttgtataagaccataacacaataggcagatggagtataagaggaaaacagactgtataaggcagaggtcaaagtcttaaagaattttatatgcca

SEQ ID NO: 405276 - DNA, 426 bp, Homo sapiens
gacatcccgccccggggctaaaagtgtctgccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtg

SEQ ID NO: 405277 - DNA, 811 bp, Homo sapiens
gacatcccgccccggggctaaaagtgtctgccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgtgtggtttcgctttgcccattccttccagtaggccctccgggtgctgttgccgaatgtcagggcgtagttgtcctgcatggcggggatgaaccccatgtagaaggggatcaggccttggctgctgtagatgtggttgctgggccagtgtgttccaggcagcttctcgcccaggtcacagtgggggtttctaaacaggaactggctcttgtcgaattcgtccatggcttgcatgacgccgtctcggtaattcaaccccattacccaggtgaaacggggaatgaagccagcgtagcctgagatggccttgcgttggattaggttagggtggtccagctgcggcagccgctggaagctgcccacatctagcgtctcctgctggcggcg

SEQ ID NO: 405278 - DNA, 308 bp, Homo sapiens
tcctcgactatcttgaatcttaaaagaattttcgttttaattttaagtatattattaagctagacagttatactgttaaacatttttaaagcagcttatgtgccatggttatacccttctttatctaatgtttttatatttcttgcatggcagattccatatgtgctcttgaacttgcctgaatgtcatgagtgtgaaggaagggtcaaggctgatatactgctttagcaatctgcatgtgctagcactgagtgacgggcaatagactcacattctctatgttactctgaaatcattcagaacaggca

SEQ ID NO: 405279 - DNA, 546 bp, Homo sapiens
agaggcttttcataaataatggtgtgctcttgtcaggggttctgggccttgcaggatggtaacatgtttccatagcagatgggtccgctcttgcctgccattctgtcttttgaacttcctgttcaagggtatggttttcatcaaccttgatgctgtagagaacacctactttataaaattggaatttttttagccaaaagaaaataactgaatgtttttgtatataaaagatttctttagaaaagaccaaaaggggatggaataaccagcccagatgtccaagtgaaaagttgtaactgtgatagaaattttttcttgtaatatatgaaaattaggactgaggagaacaatcctttctaggctcagatttcattaaatgtcattaagaaattataccttttgctataaaactacttttttggggcaaataatccctacacatatacaggtacactttgttttatggagcttcactttattgcactgtgcacatattgcattttttgtatggttttgtttttacaaattaaagatttctggcaaccc

SEQ ID NO: 405280 - DNA, 578 bp, Homo sapiens
agcgagttcacgagatctgatggttttatgtgtttggtagttcctcctgcattaattttccttcatgctgccttatgaagaaggtaccttgcttcccctttgccttctgccatgattgttaaatttcctgaggccttcccagccatgctaaactgtgagtcagttaacctgtttcctttataaattacccagtcttgggcagttctttacagcactgtgaagacagactaatacagtgggcttgttgacatagttttgcccttttatgaatgtgattatctcaattttattatgttaaggaaggacacagtggcccacacctgtaatcccaacactttgggagtccaaggcagaaggatggcttgagcccaggagttcaagaccaggctgggccacaaagtgagaccctgtctctacaaaaaattaaaaaactaactgggcatggtgatgcatgtctctagtcccagctactcgggaggctgaggtgggaggaccacttgatcccaggaggttgaggctgcagtgaaccatgttaccactgctgcatttcagctcgggtgacagagcaagaccctgtc

SEQ ID NO: 405281 - DNA, 342 bp, Homo sapiens
acgaattgagaactgagtgctagctttggtataaaagaaattaagatagaagggggaagattctaagaataacaatactataagctttttctttccactttggaaacatgtaaaatctctctgacaacaccttatcaaataaaaacctggcttctctttcatggagtgcttgcacaaagaagtttagcacctcatgtgtgagaagggggaaaaaatgagggtcttgttcatttgttgcttggttatcccttggtatgttttaaattgccttgtttgttcggcactagcacagaaacagatgttgctctaccgtgcaggataatttactgtacctcctggtgc

SEQ ID NO: 405282 - DNA, 2745 bp, Homo sapiens
  misc_feature (57)..(57): n is a, c, g, or t
  misc_feature (101)..(102): n is a, c, g, or t
gagttttaaagtagaagtacttgctagtaatgcagatagagtcagttctctcaccantatggatttaaattgtcctttccatctcagtttactcttttttnnaaaaaaaacaaaccaatatgctacctgaaactagaaacacatttttaattctgcagctctcctaacagattattttgctttagtacagagctgggctgcaggctgagttgggagttggtaaaggattgaggacagcaatgtaggtcgcctcttcctacaggaaaaaattgaggaacgttgtgtattactggttaaaagattgattaggattatttcaagggatggttgagttgtcgttttacttatttcacccaatattttgtgtctctacttaagcagtgttgttttaaatgttactggataattgtaacataatcaaattaaattttatatttaactgatacccaagcatttgatgaaaacatgttgcaggaatgggagagtattccatagcttttgttttattgtgatttgattaaatgtgacaactaatagtttaaagacaggacttcactgttttagctgatttcctgtagaaagtgtggctaagtttaattgaaagaaatgtcttcttactagaactgattttgggggactttatccactcttacttggaacactaactgttggctataagggttcaaaaaggaagcaacagttgcttatttggcatgttgaaatatcactggctattttagagtatgaagcaaactttatcaatatgttttcttttccctccttacacacaatgtagactgatagaaaattagttttagttcttctagaatttatataaattttgtaagctccacccaacacacacacacacacacacacacacacacacacacacacctgccccacttacaaaagtctatattagccttttaaaacaaaaatttcctgcgtgaaattctggcttagttaactttttggtctttctctcggggcttttcttgttcttataaaatactgtaaattacaaatggaaatttaatgcagaattaaatttctagtgtacaatatttgtaagacaagaagaaaatttccttttcccagatctcaggaactaccttgttcctgttaacttcttgaactggctagttgctcaaaggtatgtatacaggcctttagggaagagcagtttttaaaattttcctttctgatcattatatacctgtcagatgacaatagataatcttccaaagttgctacctaaaaatcctaggaaagaaactttggtgaacatgactgccattcccattaattgctaatgaaaaacatcaaacttgcttagtagaaaaacacctaatttggtataactttcttgcagtttatccatattatgtgcttgttacttaatgtaattaaaagcattttaaaattctacttttttcgtatccactttttatacttgctacttcctaaatcctccctcactgtttatttcatccatctactcatttcccatcatccaaagttagcctctccttgtataccaggcactgtctgatttccatgtattccttttatttttactgtgggcctttgtgcttagtatacttttacttcatataatgtgattaacaaatgaagtgattatcatatggagtttaaggaaattagatgtatcttgcaattactttgaaatctttgggaaaccttaagaagattgtatctgttttcatttttatttacaacatcttggaatttgttcatgatttcctaaaatttctttgcctacccacatctctgtgaaaattttccatatcagttaagtagttttcgcaatgaaaattttagaccatagatatgttgtatgctgtgatcttttgcagcctaatgtttgaagggagcatgatgcagagaggttttgttaaaatcattttagcccaaagctttgtgtaattttcctgcaactttgattttgatttctttctcaaatagacttttttaatgtttagaaaagttggaggtcaatttatgatgtgattcaagttttagatttatttgctattttcaaagttttttttaatagtcttctctttttccagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405283 - DNA, 264 bp, Homo sapiens
tatcccttgcacgctggaaatcaggactagaagcagaagtcagaacacgaaggcaggaaagggatctggtaaaacctaaatatgacctggatagaacagatccattagaaaataattatactccagtctcttcggtacctagtatttcatctggccactaccctgtacctactttgagcagcactattacagtaattgctcctactcctcctcagactccacggttaatatcacagcagctgtgtcccgatttccaccttgcca

SEQ ID NO: 405284 - DNA, 3748 bp, Homo sapiens
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacagatgatatttcttattctttggttttgacaggaccaccacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttggtaagtgttccagtctgatattttaagtgtgtacttcctatacttgtataaaaatctttgatgtttgcaacaatactgtgatttttttaagtggatttcttttgcaagtgaacatgatcattgaaagttgatatggcagtttccaggaaataaatgcattctttgtagaatgggggtgggagattacatatttatattttcaaattcatcattttgattgcaagtgtttctgcctctcttgagattatagtgataatattaaaaaatcacatttaaaaaattac

SEQ ID NO: 405285 - DNA, 4406 bp, Homo sapiens
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcagaatgtaactaagttatctgtgaaggacaggttgggttttgtatcaaagccatctgtttcagcaactgaaaaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttgtagtcgtgaaaggtgccaaattggcagaggctcacgtttcttctctttacaccaaacagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405286 - DNA, 3149 bp, Homo sapiens
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctcttta

SEQ ID NO: 405287 - DNA, 4247 bp, Homo sapiens
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcggctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttgtagtcgtgaaaggtgccaaattggcagaggctcacgtttcttctctttacaccaaacagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405288 - DNA, 2124 bp, Homo sapiens
accaatattttaaaggtacagaagatggcgtaatttgctaaagagaggcaggaaaaaatggcatgtacaaaggctttatttgatatttgtttagtgtgtttcatgcaagcaatagaatagatcatatagagaaaccattgagtggttaaatgttgcttttctttgttttgtgaatgttctagctataaaaataccttttgtattcaactctgttgagagagatgagtatttaaaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttgtagtcgtgaaaggtgccaaattggcagaggctcacgtttcttctctttacaccaaacagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405289 - DNA, 2192 bp, Homo sapiens
  misc_feature (2097)..(2097): n is a, c, g, or t
  misc_feature (2104)..(2104): n is a, c, g, or t
  misc_feature (2123)..(2123): n is a, c, g, or t
  misc_feature (2154)..(2154): n is a, c, g, or t
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctcacaaacgagggattctttcatagccctacttatccaaaagtacatttccnataagantatacttcaatgattgaantgaagccaaaataaaataccaccagggtttncaaagagtaaatatttacaatgtttctaccccattcga

SEQ ID NO: 405290 - DNA, 1294 bp, Homo sapiens
gcggccgcctactactactactactgttcgaattcaagcttctaacgatgtacggggacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttgtagtcgtgaaaggtgccaaattggcagaggctcacgtttcttctctttacaccaaacagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405291 - DNA, 745 bp, Homo sapiens
cattggagatttctgcatttacggagagcgatagagaagatcttcttcctcattttgcggtactttcttactgctcaacaaaacaaatgctgataatcatcattggggatagtagacataattaaagaggaagttatgaaaaggacataagtaatttcaactcgttaatctgaacaaagagtttaatctttaatttttttgttaatttaaaaacaaactgtaggatttgtataattatctagaagagacattactattcttacacttagtaggccatgaaatactgtgaaatgaacaatataaactttgctgtttcagagagggaagtcttgtagtttagtttgatttgatatttacttttaaagaaaaagttaacatattgcatgggccatccagatttttaaaataaggtttgtgtttgttaaaaatgtattcttgatctagctgacccagtattgaaacaagataaaattttgacctatgatcttgaagttgcctccgtcagtgtcaggatgtaatgaaaaagactttgtataatggtaatatattgacctacaagaagggagaatgggattctagtctctgttaatccattatttaacttggacttcctgggatttattaggctcatgttcaaaatgaagattatacctgctgaatggccctttcatctcaaatgctgtgattcttagtggtatcccaaaggttggttactaagcatcagttttaccctcagcattatatt

SEQ ID NO: 405292 - DNA, 511 bp, Homo sapiens
gaaaccattgagtggttaaatgttgcttttctttgttttgtgaatgttctagctataaaaataccttttgtattcaactctgttgagagagatgagtatttaaaagtgtcaccttttttttcttttcttttttttttttttgggtaaattcctaaatacattttaacctatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatac

SEQ ID NO: 405293 - DNA, 397 bp, Homo sapiens
taggaagctgttgcagttattgtggaggtgtggagtattttggcttggattagagtgattatactggagatagaaatatatggattaaatgggactgcgtaaaagttactttaaaaaggtttgtatcaatacaggatagtaattactgtcacctaaaatattaattactattttttagatgcagaaggaattacttgacacagaactggatttatataagaagatgcaggctggagaagaagtcactgaacttaggagaaagtatacagaattacagctggaagtatgtttaatcacaactacacagtaggcttaaaagaagcaaatgtagttgtagtggtcaatttaaaaatatattcccttcccttcattctcattagtaattgttggtaatccc

SEQ ID NO: 405294 - DNA, 4172 bp, Homo sapiens
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacagatgatatttcttattctttggttttgacaggaccaccacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttgtagtcgtgaaaggtgccaaattggcagaggctcacgtttcttctctttacaccaaacagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405295 - DNA, 4334 bp, Homo sapiens
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttgtagtcgtgaaaggtgccaaattggcagaggctcacgtttcttctctttacaccaaacagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405296 - DNA, 3261 bp, Homo sapiens
agtaaggtcagttcaagcagaaggagcattgctaccaaaggattggagaatgaatgcaatagggtatgtttcagtactggaagttgcaaatgattgtgttaaattgagggacagcaaccagtttcctcctgtgccatgctcttgagtgtggcttctgctttagtcactacaaatattagtaaatgtattcaacaactaatgctttctcagtgatgtagtaatagtaatgtttttctttttgacattttcatgtttttctttacttttttttctataggtatttggtgttcatttttttaaattttagagcttattatttatactctacctttcaaatcaccaaatatgatttcgttattataagtataaaatacatttagttcagtgtgttttgaagctgaagtttaacagtagtgctttaaagttgagtcttatagaaaataggatatcatgaacggctgatatatatttttaaaagttgaatttgtattggtaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttgtagtcgtgaaaggtgccaaattggcagaggctcacgtttcttctctttacaccaaacagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaagccaacaaagaaaataattttcttccaagtga

SEQ ID NO: 405297 - DNA, 2777 bp, Homo sapiens
  misc_feature (2688)..(2688): n is a, c, g, or t
  misc_feature (2713)..(2713): n is a, c, g, or t
  misc_feature (2767)..(2767): n is a, c, g, or t
  misc_feature (2772)..(2772): n is a, c, g, or t
aagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaacagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaaaatgggtttttnttcccccattacctttttattaagncccatttttatttttttttttaaaaaaccaccccttttaaaggaaaaagggganacccnaaaaa

SEQ ID NO: 405298 - DNA, 720 bp, Homo sapiens
gttttgctaactatactatagacctataagatgtgaacattaagagcagctgggcaaaagctatacaggagttctcaactattttttaatcttttctctaaaagtagtttagaattaaaagttaaacacaaaaatttccactgatgaaggcttcccataaactatcaaatatggttataagaggaaaaaaggaaacacagaatattgtgtaaagcaagcttgtccaacccgcagcccgtgggctggatgcggcccaagacggctttgaatatggcccaacacaaattcataaactctcttaaaacattgtaagaatttttttgcaattttttttttattggttttttagttcatcagctattgttagtgtattttatgtgtggcccaagacaattcttcttccagtgtggcccagggaagccaaaagactggacacccctgggaaagatatcacaaattgttctagaaagcccattttgaaaatgcgccaatgcacatcaaacttagcataataaagttacactgccagacatatgaactcacaaaaagaattagctccattatgaaaaacagctaaatcatctatataaaatgctgtctatctagaaaataaacatgaatccaaaacccttacattgttctaaaccacactaatgttcccaatgagacaagaaaaaaacagtcatgaattaatacagaaaaagatatttaaaaaagaaa

SEQ ID NO: 405299 - DNA, 638 bp, Homo sapiens
gcccctgcagcaggctccctggctctgtccctctctgtctagtgtgcgtcctgcaaggctgttgcctcagtgtggttctgccagcattcctgggggcgtcactgaggggtagcccagttggcacctccaaccatggacatcttggagtcaggaacgggggccttgcatgctctggggaccaacaaggcctgctgtcattagggtccctgatcctgggtgacactaacaagaatgcaggagcccgagtttggggcttcacattcatacttgagtatggctgtcgggccccccgtggcctgtaaacaagctgtgatggagcacgtgcttgctgtgtttaggcatcacgcttggcgcttggcacacattctcttctttcatcctcaccactctataggacatgcgcctgcattccattgtccctttgcaaaagacattctcaacaccacgacgccaaaggaatcctgtgtgtctgtgttgtatgtcatcaaggagaaaccacctttgtctgcagaaagatctcatggctaccctcaccaccctgcccctatgaagcctgagaaccagctggctcagcagggaaggccgcaaagtcaggagcgaccaaagtccaagctccaacgtgcctctcgttctccaaa

SEQ ID NO: 405300 - DNA, 451 bp, Homo sapiens
tgagctcgggtacccaagttattagaaaaataaagaaaaaaaaaaagctttcttcactaaaaattctgattctgtacatctgagttgcttgaatatcaatatatttaatcttaccaaatggtttttattcacacctaaatttgacaaagttaacctgttcccttatgcacaccaccatcttacataaattcattattggcacccttttcctttttcagatcccttccctgaaagtattatattttatacttaggccatttgtttaatggattttgtatgcatgtatgttataggaaaataaaataggtttgccttcttcatttctttcagatttggagtcaaaatatggacctgagaaaatatctccagaaaatgatatttttgaaataaatttacccaaacatgttataaagcaaataagtaaaacacttggcctcgaggcctttttttt

SEQ ID NO: 405301 - DNA, 440 bp, Homo sapiens
gtgcgggtgggcgagagcgaggcgctcagaggaggaacccggggcgcagacggaatctgccagatccttaggcgggagaagcccgaggaagattgaccaattttgtaattctagaaacatggtccatggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttatttggagtcaaaatatggacctgagaaaatatctccagaaaatgatatttttgaaataaatttacccaaacatgttataaagcaaataagtaaaacacttggcctcgaggcctttttttt

SEQ ID NO: 405302 - DNA, 422 bp, Homo sapiens
ggtgataagggtcatcttctatgaatagctttcttcctggaactgactggacttcacaaccaattttgggctagtgtggagagatcagctgtgagaaacatccattgatttgctcaggctgccctttgtatcttaatgcttcaggttttgttatcctgcgcctttcttctgtcttctttcctcataagttttttagatacaattttattgccaataattaaagagtgagaatgagcggcaatgggctggtatggttgcattcaaactccaaagttcacattttggaatattgatttttgcttgagaacaacttacctaaaaaccatgggaatttggcagggagggatgtgatggggcatatgttgagttctttcaaggaatttaactttcatttctgaagaagtaaaaactgtggcatggtg

SEQ ID NO: 405303 - DNA, 388 bp, Homo sapiens
aggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaag

SEQ ID NO: 405304 - DNA, 515 bp, Homo sapiens
  misc_feature (8)..(8): n is a, c, g, or t
  misc_feature (13)..(13): n is a, c, g, or t
  misc_feature (17)..(17): n is a, c, g, or t
ttttgaanccccntttnactactactatgctgcgagaagacgacagaatgggcatgtaacagaaccaattttaccacaggctaaatgatagaaacaagacttaagttcctatggcatatttctagtcacaaaaacatcaccaaacttttaataaagaccaaaacatttctaatattaaacattgaaataaatgtgagttatgcatacatttaagaaacagtaacaaaaacaagtgagataattattcactcaatgatttcagttcaagggtatgggtggccagagcctatgcagctcaggatgcaaggcagacactgacaccagacaggacgtcatcccagagcagggggcattcacacacgcgcacacacacgcacacgcacacacacacagttactcagactgggaccatttggacatgccaatttacataacatgcagtacgtgtttgggatgtggggggaaccagagtatccagagaaaacccatgcagacttggggaggatgtgctaact

SEQ ID NO: 405305 - DNA, 488 bp, Homo sapiens
gaaactgcgagtttaagcaaaacggcatgtaacagaaccaattttaccacaggctaaatgatagaaacaagacttaagttcctatggcatatttctagtcacaaaaacatcaccaaacttttaataaagaccaaaacatttctaatattaaacattgaaataaatgtgagttatgcatacatttaagaaacagtaacaaaaacaagtgagataattattcactcaatgatttcagttcaagggtatgggtggccagagcctatgcagctcaggatgcaaggcagacactgacaccagacaggacgtcatcccagagcagggggcattcacacacgcgcacacacacgcacacgcacacacacacagttactcagactgggaccatttggacatgccaatttacataacatgcagtacgtgtttgggatgtggggggaaccagagtatccagagaaaacccatgcagacttggggaggatgtgctaact

SEQ ID NO: 405306 - DNA, 412 bp, Homo sapiens
cgataaatggtaatacaaaaaaaaatgccctatatcaaattttaagcggaataaatgcatgcgaattttcgaaaagcaataaagtggtttttacttatttgaattgcgttacattgaaatcccctgttgggggaatttgtgggcgagagctggaaattattggcccatttaagggagcagcaatcttactgcagtgcagcgtttatgacacttgaaaacagattggagagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgc

SEQ ID NO: 405307 - DNA, 426 bp, Homo sapiens
gaccccatccacccttcatcagtttgtatcttcaccactatctgaccttattgctgctgacactccttgtcacaggatgaaatcccaagatgatgcaggtgttcctcctagagatgttaagtgcctgcttgggtggaaaccgaattggagttaaattcaagaagccctgcagacaggactactagtgtctctttctggtttggccacaggacaatgaaaccctggaagacatctgttaattggtgtgctcctcttctttttagaagagtggcttttttgcagtgggaggtgatttggatgccggacattcttggcccacctcccacttcactgcagattcaacatgcacataaaaataaggaacacaaagccacacagccaaagcagagccacacagacagggcaataaaaggtttgagactcaaa

SEQ ID NO: 405308 - DNA, 380 bp, Homo sapiens
agaagcagtaagaaacatcgaggaatttcccaacatatcagggaatttgttatttcttctaaaacataaggaagtacgtggcaatataaatggcaaatgtgcggggtgcggtggctcacacctgtaatcccagcactttgggaggccaaggtgggcggaccaagaggtcagcagtttgagaccagcctgcccaacatggtgaaaccctgtctctactaaaaatacgaaaattagctgggcgtggtggcgggtgcctgtaatctcagctactcaggaagctgaggcaggagaatcgcttgaaccttgggggcggaggttgcagtgagccaagatcgtgccattgtactccagcctgggcaatagagcaagactctgtctca

SEQ ID NO: 405309 - DNA, 142 bp, Homo sapiens
agagataaaaataaggcagtatgttattttaaataatcctaaatgtagcttccaaccacttttagactcctgcacagagatagatgcagtactattgtaaaaaacccaatgttgcgaatgtggcatctctccccagcctgac

SEQ ID NO: 405310 - DNA, 178 bp, Homo sapiens
aataagatcagacacctacctcactagattctggaggttaagtgaactaatatatgtgaaccattcttagcactgagccacacatataatggggagtcaataaatgttagctctccccacccccaacccccaacccactgcaacctgcctcccaaggcctaccgtgtacttgcgaatt

SEQ ID NO: 405311 - DNA, 368 bp, Homo sapiens
ttggctgcaagactgtctagtagcctgcacttccaagtctcgctgccttctgggtgtggccaaagccctgttgctgcctctgggatccctgctcctccccatcccctgccagctcactctccagcctgacccaccgcgtttgctcttggtttatcagctcatgcctgtgatgcttcatcccagtgggtgaaagacaagattctggctgctccctgcctcaccccctcctcattcctcactggtgattcctaccgaggtccagggtaggccagggcctatggggagacctactatggtttgagggtagccaccctcctgcaggtgtgatagcaaggaggaacccacgtggggcccgggaagtcctatgg

SEQ ID NO: 405312 - DNA, 644 bp, Homo sapiens
gtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcac

SEQ ID NO: 405313 - DNA, 456 bp, Homo sapiens
aatctggaattagctcaaaggttcatcgacaaactgtggcatatccatggaatagtataatactcaacaataaaacagtgatgaacaattgatacactctatagtagggataaattcaaaataaatactctgagtgaaagaagccagataataatgagcacacagtgtatgattttattatagaaaatcttagaaaatgcaaactaatgtaccacgacaaaaaacagattagtggcagcctgaagatagaaaaaggggatgtcagggaaggtattgaaagaaaacattgcaaaggagcacaagggaacattgtagggtacgaattcttaattattatgatagtggtgattgtttcacaagtgtatatatatgctgaaatttaacaaaatttacacttaaatatgtgcagtttattgtatgtcaaatatagacaaataaaggtattaaaaacaaacc

SEQ ID NO: 405314 - DNA, 357 bp, Homo sapiens
caaatgatggatagtccaatggatttgaggatgtcacatatcttttccaagactaatggttaattaggctgaattaaattatgtgacaaaaagcttagtttctccactgtgaacactgtaacttagtggctaggcttattcatctactttgtggctctgaacagctctccagatagcttagaagtttttggacacaaaaactgagtcctatattatgtttctactccaaagcactaagtcatatgtcttgtaagtgctcaggaaatgctaattaaatgaataaattaactcagtacattctatgctgtattatatttatataaaagggacaaattttctttgctttattcattttca

SEQ ID NO: 405315 - DNA, 564 bp, Homo sapiens
tatccaagacaatacatctttgcaaagctgggttttctgtggctgctgtgataaaagccaaatgctgcggaaatattaatgtgaaacaggaaatgagagtggcagtgtccaacacgatcccaaggcttgaaaagtagtataggcacacacatacggttagtaattatgactttaaaggatgtaaaatattttttctctcagtttatgtatattattttttcaaacaacttctaagtaaatactcagttgtttgaacctaactactaactactgaaacctaagggaattgtgaaaaaattactaactactgaagcctaagggaattgtgaaaaaattaactcagacactaagggctccatgaaaccaagtttcagaatctttgccttaaccaagaagtaacaaaacagtgtaagattcaccaaggaaagccatgtgaccttgaagaaataaaacaaagacaataacacaaacatatcaaccaggaagaggaatttgggttgttaaaaccatttttaaaggtcactcttagcttaatccttcaaatcccacacaatgccttctgga

SEQ ID NO: 405316 - DNA, 361 bp, Homo sapiens
aagcaactgctggagccacataggtgaatttgttatgctggaagggggtggtcacctggcactgtgagtggctcagagatccctaagtgatcagaattgtaaacgacccaggggaaaaccttgggaaaaaactcaccctcttagatactgagtttctaggggaggagagtggcttagaagcccctaaaatgggtcagatgagaaaaggacagggccagagagggggagggagttgcccagagacacagagcaaccgtgcaaagctggctagagccagagcctgcgccttccagttccttgggtacaggctgtccacgcaggcatccctggtgggagtgagggtcacaatggctgtgacctt

SEQ ID NO: 405317 - DNA, 313 bp, Homo sapiens
tgactgtgatcatcctgaaggtgtttccctcaatgctgagtgcttggagccgctttagaattgctttcactctctgttaatttggagaacaaagaatcaataagtagaaggagattgggaaattagtgatcggggacggtgcagagttcataaataatttaaaatatacagagttctggcttttcaacagagattttaataaaagatgaacaaggtcatcttcttccttctgatgaaagttacccatctgtagtgccatggcggatgctgtgtacaagagctgaaatggtggttcctgttaactttgagagct

SEQ ID NO: 405318 - DNA, 783 bp, Homo sapiens
gcggccgccgcggccaccgcccactcggggctggccagcggcgggcggccggggcgcagagaacggcctggctgggcgagcgcacggccatggccccgtggctgcagctctgctccgtcttctttacggtcaacgcctgcctcaacggctcgcagctggctgtggccgctggcgggtccggccgcgcgcggggcgccgacacctgtggctggagggtaaggcgagggcggcgggtttcttgccgtcgccaactcgcggggaacgcagcgcgcacaggtgctcgcggggaggcgagcccgcgccaacctgtctgctcttcgcggggtccgcggccggcctgggtctcactcctcccgcgcatcctcctggtttccctccccggacgcgtgtcctccggccctggccgagatgaaagcggctgcccgaccccggctttgtgttgctaatgagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactgtaagtcacactggggaacgtgctcctgaa

SEQ ID NO: 405319 - DNA, 573 bp, Homo sapiens
agacatccgctcttcttttcctccgggaaaagaaacgggaagtggccgtgggccggtgaattccgtgtagtggccaagcttgttccaaagagggggaggtgttgacagtctcttgcccactgaagcgtgccagacagagtgctaggcatgggggcagaggtgaatcagatgacagccacctctcaccacgaggagtggctgaaagtgtgactggactacaggcaatcctggccttggcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactgtaagtcacactggggaacgtgctcctgaa

SEQ ID NO: 405320 - DNA, 110 bp, Homo sapiens
ccaagaccaagaatgaaagattggtttaacatacaaaaatcagtcaatattccatattaataaaatgaagaaaaagaaacatatgattttctcaaaagatacagaaggta

SEQ ID NO: 405321 - DNA, 366 bp, Homo sapiens
tactgccttcactgcaatcttcctaatcccctcaagatctctaaggtcgatattacgatcctcattttaaaaatgaagaatgttggccaggcgtggtggctcatgcctgtaatcctaacacttcaggaggctgaggtgggtgaatcacttggggtcaggagttcaaaaccagcctggccaacatggtaaaaccccatctctactaaaaatacaaaaattagccaggcatggtggtgggtgcctgtaatcccagctacttcagaggctgaggcaggagaatcacttgaacctgggaggcggaggttgcagtaaccagagatcatgccactgcactccagcctgggcaacagagcaagactttgtctc

SEQ ID NO: 405322 - DNA, 498 bp, Homo sapiens
gcatgattcaacattcactcaacaaaatatttattgagcgcctgccaatgctagacccacatgctggccagcatccctgcctgtgcaagctctggatgagctgtgtgcccctgccacccacacccccactccctgccagcctggcctcagggcctctgatccatgtgcactggagtggtgatgactgacagggccactggggcatttccatgttaacagcagctgccactggcaaaagaagtgactcgccaatggtggcatctcagatgtgggcccaggagtctggggagctactttgaacagggctatccattcattgtcccaccaaaggctatggagcccacccaccatgtgctggagtagtcaagggaaataagacactctccttgtcctcgttaactcaatcaacaagcatttgcagagcaccgcctgtatgccggcgctgtccgaagtgctgaagatacagcaatgagcaaaccaaaagccatggacatcgga

SEQ ID NO: 405323 - DNA, 415 bp, Homo sapiens
ctgcacttcctacttatctcttacagcctctcacacagccctgtgttgattcagtggcttagaggagtacacagagctcaccatctccacctttgagcatgagaaggggaaagcttaaacctcctcagcagaaagcacctccactaaaggtccaacctctagcagcaagactgagcctaggaacccactggagtcctcagaagaatgcccattttctctttgtctccaggccctagccttactctgcaggctcagctcacacagtgtcctgctgagtctgccactactatcatgcagcctaaccccaccagtccccacttaacactgggagatttctctgtaattatccccactgccatttctgagtgagattggtagagggtttataaaagattgctgagatgtagttgactgg

SEQ ID NO: 405324 - DNA, 1418 bp, Homo sapiens
tcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacacacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataagctgctgagcaccccgctgcacgtggcagtccggacagggcaggtggagattgtggagcactttctatccctgggcctggaaatcaatgccagagacagggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgctaaaaaaaaaaa

SEQ ID NO: 405325 - DNA, 592 bp, Homo sapiens
tttggttaggaagtaggaattttatgaggacttttattgtaaactgtgtcaagggaaaaatcatcttatactaaacgtctttattgccaaactagaataccttcacaatctgaactttctctagatgggcacagatcatgaataactcagaaaccattagcatattgtgtgcttaattaaggctggaaagtgctgaggctttttgcaggcgcagttagcaggcgaactggtcagcagggtttctggggaacgtagatttgcgtgacaggggccctgtgttgctaaggaattaatgcaggcactgagaaaagtctcagcgtcagacactcctccacctcccgggtcctgcttccctccctctcccctttccaggcaactcacagtttaggggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaaaaataaaagaataaagaataaaaagaataccactactactataaaaaaaaa

SEQ ID NO: 405326 - DNA, 334 bp, Homo sapiens
tcactgcaacctccgccttccaggttcaagcgattcttctgcgtcagcctcctgaatagctgggactacaggcgctcgacaccacgaccagctcatttttgtatttttagtagagacggggtttcaccaggttggccaggctggtctcgaactcttgctcaggtgatccgtccaccttggcctcccaaagtgctgggattacaggtgtgagccactgtgcctggccagcggtcccctttttacagtatatcaaatttcccttgttacccacttcagtaatgttttacctaactcatttctaaccactcaattgattatttcctgtgagctgtca

SEQ ID NO: 405327 - DNA, 1095 bp, Homo sapiens
actgcaacctctgcctcccaggttcaagcaattctcctgcctcagcctcccaagtagtggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405328 - DNA, 439 bp, Homo sapiens
ttccctcccgccctggtctcatgccttgctctgtgttgaggaaaacagtggaaggagcgtggccccttactggcactttcaatgccatccgcctcccgggatgcactttttaaggcaaaacctttcaatgaagaagcatgttttgctgtcggcagagggatccgtgttggaatccggggtgcgcgggccctcaaggttgccccggatggcgggtgacagtgctgtggggctttgccctgtggcttccgccgtcggcacacaaggagctgctggagtgccgtcacagcgccaccccctcgatgcccacagagctgcagcctctgcagagtgtcagctccttcacactgtccaacttgatctcagcgattttttgtcataacacgtagaaactgtcagagcccgttttaaacattgtgcttttctgtctgcaaagtcatta

SEQ ID NO: 405329 - DNA, 599 bp, Homo sapiens
acctcgtccttctggtctcttccagctaagaagtatagaaaggtcgctggcaaagagatctactcggataccttagagagcacgcccatgctggagaaggagaagtttccgcaggactacttccccgagacacagttaccgacaggaaatgaacacagaggctccccggggcaaatggcctccccgagagaggaggcggacatgtttggaatcagagacaagtgtctggtgcagcacgcagggagcctgccaccccgccaccccgccatagagctccctgggtcgtctgggcatggccccatgcagcagccagaccagtagcctggggatgccttggccagcctcctggagctttggcacagcccatgttgtttggcaagcagggcagcctgagcacagcaggggatgtgggctcagtaccagagccagctcgtggtgtgaggacggatcctcctcgacgagtagagccatagcctggcgtccaagtgcgtggccaggccgggaggagtgtacaggaagtctctgtaccttatgctcaattcttctggaagcctaaagctgctctgaaaaataaagcctattacttctttaaaaaaaag

SEQ ID NO: 405330 - DNA, 265 bp, Homo sapiens
  misc_feature (69)..(69): n is a, c, g, or t
tgtatgttttattattttactttagaacactcaagctccgcccccccccaccaccccgtgtcgaatatnctaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405331 - DNA, 2735 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405332 - DNA, 3255 bp, Homo sapiens
  misc_feature (2796)..(2796): n is a, c, g, or t
  misc_feature (2808)..(2808): n is a, c, g, or t
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaaaccaaacacnaaccaacaaaanaaaaattgggggggggccgggccggaaaagggtttcagaaccatccggtggggggggggggccccggggagggaacacggggccaaagggggcccaaagaaaacccgggccgagaaaggggggggggtctccccaataaaaaaacgcggagagacccgcgggagcaaggccaatggcggaggtcagggggctccacgaatttttccaggcatcccaaagacgctcctccgcgggagggtggggtgtgaaaacaacaaacaaacaaagaaacacacagcaaacaacgagaagcaagtagatagaaacaaagacacagcacgacacgacacaaataaagaaaatggcagaatagatacaaatacagacagagatgccgacagctaaacaagatacaaacgctaaagaagtgaacatcggcgatacaacaacaacagcacaggcgggggt

SEQ ID NO: 405333 - DNA, 1689 bp, Homo sapiens
cggccggctggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405334 - DNA, 1781 bp, Homo sapiens
tgtgcacaagggccgagctgcctctgctggccatcagctcctcccagcccggttcatggctgccctggtgagacgcagggtctgggggtgcaacgggaggcggcggcatgtgctgtgctgtcccgcgtgcgccgtgctgacaccgtcctctcttcctgctgcagcccgtgttcctggccttccgaatcatgcccggggcaggtaaacctcatgcccatgtgcacaagtgttgtgtcgtgcagtgacgtggtggtaaatatgactcctccctccagttcagcttttacgcagcttttcctggtgcgtttgttcctttaacaaattacgaattccgtgacagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405335 - DNA, 1043 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagacacagttaccgacaggaaatgaacacagaggctccccggggcaaatggcctccccgagagaggaggcggacatgtttggaatcagagacaagtgtctggtgcagcacgcagggagcctgccaccccgccaccccgccatagagctccctgggtcgtctgggcatggccccatgcagcagccagaccagtagcctggggatgccttggccagcctcctggagctttggcacagcccatgttgtttggcaagcagggcagcctgagcacagcaggggatgtgggctcagtaccagagccagctcgtggtgtgaggacggatcctcctcgacgagtagagccatagcctggcgtccaagtgcgtggccaggccgggaggagtgtacaggaagtctctgtaccttatgctcaattcttctggaagcctaaagctgctctgaaaaataaagcctattacttctttaaaaaaaag

SEQ ID NO: 405336 - DNA, 2786 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405337 - DNA, 812 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggggcttattcagatgaaaaagaaaaacaccactgggggagcagcaaattagacattgcagaagaaaagagaaggtgactgaacttgaagacagccacaaaattaaagtgaaacagagagaaggactgaaaagtggatagaaatcactgtgaaataccaggtgtcctaacacgtgtggctgcagccccaggaggagcggggaaaggaggcagacagggtgatgcttacagatgtcatggctcagatttcttcatcagtccatgaaacttacagaaagatccaaatactgcaacaagcttcaagccgaataaacataccaacgcaggccaaggtccgattgctgaaagcaagttacatgaaggcccttccttgccacccatcatcctcggaagagtggggctctgctcc

SEQ ID NO: 405338 - DNA, 2732 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtctttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405339 - DNA, 3043 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaatagtcccgtgttgctttttcttcctttcccttctcctgccacctttgaaatgctaactcaggggagcggcctcctgtatagcctgttatttgagatcaagctcattagaaatcctggaatttcactgtatcacacgctgtcacaaaacactaagccgttcattgagaggagaaaaacagccttttggactttctactgtaataaaggatttatccctcaacattttaagacgggattatatcaacctttgccttcct

SEQ ID NO: 405340 - DNA, 2597 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaa

SEQ ID NO: 405341 - DNA, 1202 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgcgccagtgtctctgcaggagtggcgtgagcggcggccgggacagctcctgacagatgggcaggatcagccgctgccttgtcattgtccacacggccctgcctgccttcactttgtaatcaagaagaatgtgggagaccatgcgaaattggtgatcatgtttgtgaaaaatctcagagagatacaaattatcaattcaaca

SEQ ID NO: 405342 - DNA, 746 bp, Homo sapiens
gaattccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgccgtcggcacacaaggagctgctggagtgccgtcacagcgccaccccctcgatgcccacagagctgcagcctctgcagagtgtcagctccttcacactgtccaacttgatctcagcgattttttgtcataacacgtagaaactgtcagagcccgttttaaacattgtgcttttctgtctgcaaagtcatta

SEQ ID NO: 405343 - DNA, 410 bp, Homo sapiens
atgttgaaaggaaatgattaattcccaataagcaatataaggacaccaacatttgggagaatcgcggcagcgtggcagcaagggacacaggaaaccaaactgtgctgttctccctcaggatggaaaggccctgaggaaaggaaggggtaacacagggagaaagctgagggagaggagaacagagccctttccctccaggagctgcggaagggaggaaagtgaaggacaaaatcacacggtctcattcaagggacagttggtgtcagtgtcctggttgtgacatggtactgtaatagtgccagatgttacccttgggggaaactgggtaaaggtagacagagttcctctattatttctgaaactctctgtgaatctataattctcaaaataaagaggttttttaagtaaaa

SEQ ID NO: 405344 - DNA, 684 bp, Homo sapiens
caagaattcccttgaatcatttttctggcagcagggtgtcctccccaaaggcaggactattatccatgtgacctcccaagatccatttctctcctttgatttattcagtgacctcctctggtgcaaaaaatggtatctttgtggcttaaaagagtttttccccctcctccttcttcactctgagtcatttatttcttcctgccagtaggacacttctcttgttcattcccaaatcatccctgtaaagaaggcagtaagggtataaaaataaacccttcggaagcagaaatggctccaaagccctctgctaggaccaccccaccatcaccgtcatggagtaaacttggttagaatgtcagctctaaagtctgactacctcaattcacaccctcactccacactcagcagctgtgttaccttgggaaaactacttaacctctttatgtttttatttttccctctgtaaaaaggggctaaaaataacactgacctcatagcattttgtgaggatggaatgcgggaatacagcaaagcactttgaatagtgtctgccacgtggtaagagctcaataaaaattatctagaatttctttctgaggccactataaattctcagcattgaatatatacatggataaatgaaaaatgggattaaatgactcgcagagctcagagtaaaaatgc

SEQ ID NO: 405345 - DNA, 294 bp, Homo sapiens
taaatgagctggtacggcatgtgctgtaggccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgtgctcctacatgttcgtggacgagaacacgttctccaacgacgccctgaagacctacgctggcctacagcacatgccggtaccgagctgat

SEQ ID NO: 405346 - DNA, 1253 bp, Homo sapiens
tgggcggagctcgcgcaagcgcctgggctctcccccatggctccgcccacagcccgtcccggcccgggcccccaccctcgacatgcgcttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgtgctcctacatgttcgtggacgagaacacgttctccaacgacgccctgaaggtgacgttcctcatcacccgcctcacggggccagccctgcagtgggtgatcccctacatcaggaaggagagccccctgctcaatgattaccggggcttcctggccgagatgaagcgggtctttggatgggaggaggacgaggacttctaggccgggagacccttgggcctgggggcgggtgctctgggaagagttcgctgtgccagtggccaccgctagggtctccacaggcgccctccctccgcgcctccctccccctcgagccgccgcgatgtcccctgcgctcctgtcccctcccgcgtagtgcttgcctttgttccaggaatagcgctccaggctcctgctgcagctcctgggccgcactctagagcgcgctgcctccgccctcttttgccagcccagcccctccatgcacatttggacgctgtcctgcacttcaggtgcaagctgggctcctgttacatactggacagaccacccacagccgctgctgccaacccacctccactcctccagactgccagccaactacatcattctgcccacagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttggcttgtgtcgccagccaacaggatttttttttttttttttttttttttttaggtttcctgttg

SEQ ID NO: 405347 - DNA, 1380 bp, Homo sapiens
tgggcggagctcgcgcaagcgcctgggctctcccccatggctccgcccacagcccgtcccggcccgggcccccaccctcgacatgcgcttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgtgctcctacatgttcgtggacgagaacacgttctccaacgacgccctgaaggtgacgttcctcatcacccgcctcacggggccagccctgcagtgggtgatcccctacatcaggaaggagagccccctgctcaatgattaccggggcttcctggccgagatgaagcgggtctttggatgggaggaggacgaggacttctaggccgggagacccttgggcctgggggcgggtgctctgggaagagttcgctgtgccagtggccaccgctagggtctccacaggcgccctccctccgcgcctccctccccctcgagccgccgcgatgtcccctgcgctcctgtcccctcccgcgtagtgcttgcctttgttccaggaatagcgctccaggctcctgctgcagctcctgggccgcactctagagcgcgctgcctccgccctcttttgccagcccagcccctccatgcacatttggacgctgtcctgcacttcaggtgcaagctgggctcctgttacatactggacagaccacccacagccgctgctgccaacccacctccactcctccagactgccagccaactacatcattctgcccacagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaagtaaatttttatttttccgcgggccaaaaaaataagagacaaaaacaatattttttttagttataaaaaaaagtatatcccacatggagaggactattggttagaccttaaaaataaaagagtaaacaacagtaagccctgctcccttccctgctctaatacactacctgtacaaaggttttttccttatttttaataaatgtcagacactattaaaatagaaactattaaatagaaaaaaaaa

SEQ ID NO: 405348 - DNA, 636 bp, Homo sapiens
taaatgagctggtacggcatgtgctgtaggccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgtgctcctacatgttcgtggacgagaacacgttctccaacgacgccctgaagacctacgctaccactgccatcgccatccaccgcatctcaccaacagactgtggctcctagtgatgtggactcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgatgggtgccttttgttcaacacagtaagccctgctcccttccctgctctaatacactacctgtacaaaggttttttccttatttttaataaatgtcagacactattaaaatagaaactattaaatagaaaaaaaaa

SEQ ID NO: 405349 - DNA, 1046 bp, Homo sapiens
tgggcggagctcgcgcaagcgcctgggctctcccccatggctccgcccacagcccgtcccggcccgggcccccaccctcgacatgcgcttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgtgctcctacatgttcgtggacgagaacacgttctccaacgacgccctgaagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgatgggtgccttttgttcaacacagtaagccctgctcccttccctgctctaatacactacctgtacaaaggttttttccttatttttaataaatgtcagacactattaaaatagaaaaaaaaaaacaaaaaaaaaagaagaaaaaatgaaagagaaaaagaaaaaagggggcagccaataataaattcccgaagggacaccctatgactgtgacacacagagtgtattataaaagaggggcccatataagaaagacaaataataaacagcaaccaggtgcgaggataacacaaacgcgtatgagtaaacaaaaaacagagggacgacaattgagaagaacacacacacatgggggcggaaaacatgagacacacccaa

SEQ ID NO: 405350 - DNA, 1594 bp, Homo sapiens
tgggcggagctcgcgcaagcgcctgggctctcccccatggctccgcccacagcccgtcccggcccgggcccccaccctcgacatgcgcttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgtgctcctacatgttcgtggacgagaacacgttctccaacgacgccctgaaggtgacgttcctcatcacccgcctcacggggccagccctgcagtgggtgatcccctacatcaggaaggagagccccctgctcaatgattaccggggcttcctggccgagatgaagcgggtctttggatgggaggaggacgaggacttctaggccgggagacccttgggcctgggggcgggtgctctgggaagagttcgctgtgccagtggccaccgctagggtctccacaggcgccctccctccgcgcctccctccccctcgagccgccgcgatgtcccctgcgctcctgtcccctcccgcgtagtgcttgcctttgttccaggaatagcgctccaggctcctgctgcagctcctgggccgcactctagagcgcgctgcctccgccctcttttgccagcccagcccctccatgcacatttggacgctgtcctgcacttcaggtgcaagctgggctcctgttacatactggacagaccacccacagccgctgctgccaacccacctccactcctccagactgccagccaactacatcattctgcccacagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgatgggtgccttttgttcaacacagtaagccctgctcccttccctgctctaatacactacctgtacaaaggttttttccttatttttaataaatgtcagacactattaaaatagaaaaaaaaaaacaaaaaaaaaagaagaaaaaatgaaagagaaaaagaaaaaagggggcagccaataataaattcccgaagggacaccctatgactgtgacacacagagtgtattataaaagaggggcccatataagaaagacaaataataaacagcaaccaggtgcgaggataacacaaacgcgtatgagtaaacaaaaaacagagggacgacaattgagaagaacacacacacatgggggcggaaaacatgagacacacccaa

SEQ ID NO: 405351 - DNA, 1154 bp, Homo sapiens
tgggcggagctcgcgcaagcgcctgggctctcccccatggctccgcccacagcccgtcccggcccgggcccccaccctcgacatgcgcttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgtgctcctacatgttcgtggacgagaacacgttctccaacgacgccctgaaggtgcaagctgggctcctgttacatactggacagaccacccacagccgctgctgccaacccacctccactcctccagactgccagccaactacatcattctgcccacagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgatgggtgccttttgttcaacacagtaagccctgctcccttccctgctctaatacactacctgtacaaaggttttttccttatttttaataaatgtcagacactattaaaatagaaaaaaaaaaacaaaaaaaaaagaagaaaaaatgaaagagaaaaagaaaaaagggggcagccaataataaattcccgaagggacaccctatgactgtgacacacagagtgtattataaaagaggggcccatataagaaagacaaataataaacagcaaccaggtgcgaggataacacaaacgcgtatgagtaaacaaaaaacagagggacgacaattgagaagaacacacacacatgggggcggaaaacatgagacacacccaa

SEQ ID NO: 405352 - DNA, 1055 bp, Homo sapiens
tatctctaaaaacaacaacaacaacaacaaacaaacaaaaaaccccatgaatttttactgatatttctaattcaaatttaggattgcagggttttgtttaacctctttgactttatatcattttttttcttatactgaaaatcttgatcttaacaacagtaatgtggttacttactcttttcctacacacacagagatctgtaaaatcatatatattatttgtaatatatatgaatccaagtgacaatatgaatgttattgttagcagtatgattactttgaagtcacttgaaataatttctctctattgttgttaagccacaaattcaatacacagttaaggttcatttgtttttatttgctttcagttttggggggttgcttttttcctttcaattttaccttacattatgtagatcatttatattgttccaaagggaaattttaaaaagttaaatacaaattgtgttcagagaggtctagcttccatctctgctccctccattctgtatcttcccattctctgtagttagctaaatgttttaaaacacctttttggttataatttctattgtttgtttattttaggaaaatgcattcataaaaaaaactttactgaggtgtaatttacataccatcaaatcaactaatttaatgatttttatgagttgtacaatcatcaccataatctagtttggggacattttcatcatccaaataagatccttcttgttcatttacagttactgcacattttcatcaccagcctcaggcagccactaatttattttctatcttgatagatttgcttattctggacatttcatataaatggaatcctatgatagatggtcttttgtatctggcttttttcacttaacataatattttttggttcatccatgttgtggcacatatcagtacgtcattcttttttattgctgaatattctgttgtatggatatatcatgtattttgtttaaatattaagccagttgatagacatttgagtggttttcactttttcactgttataaataaagttatttgcatac

SEQ ID NO: 405353 - DNA, 587 bp, Homo sapiens
agggtcagacaatgaagaagctggggcagccaagagtcataagaatgggagcctgcccacctgagttcctgagggcttgcgtcagaactgagaaaggcagctagacgttcagcctgcccctcaactctactccgaaccaatctccctgagacccagggccatggtcagagcagatagagaatgggcctatcctaagaccttggcctttcagagctctgtccatcccgacacctgacccctcgcatggggagtggggcctggtgagtgttctgtttgggtgctgtagggtaagaaaaagggctcccaccttcccaggtttccctgccccagtctatgtgactgggggaagaggcttcatccagcactactgcgtgggacactcttgcctgcccatcatatcttcagccagtagtgaacgtgctggtgacccatttcataggtggtggcctggaagtccagggttgttgaatgaccacgcacacagtcagggaggactctgaaggtagggtcctgggacacctggcctgacagagctgccatcagctctgacagctgacacaggcacgaaggcagctagcctaagccac

SEQ ID NO: 405354 - DNA, 278 bp, Homo sapiens
gactcacccaaggccacaaagccagtgttaggcagggctgtgccagaatccaggttgtaaccattatgctctgtcacctcccaagtatatggaaataatttatgaattaggaaatgataggtgtgtcaactctcctcccccacatccacaagccttctaataatcttttgcttttcagcagaagtctcaagactggagagtgaccaaaaactgcagtgttcactgattttatgtatagcacattaaagaatagcattggctagattttgagatttttt

SEQ ID NO: 405355 - DNA, 1985 bp, Homo sapiens
tcagctgtcaccaaggtcactgctgcctatgaccgccaacagctctggaaagccaacgtcggctttgttatccagctccaggcccgcctccgtggcttcctagttcggcagaagtttgctgagcattcccactttctgaggacctggctcccagcagtcatcaagatccaggctcattggcggggttataggcagcggaagatttacctggagtggttgcagtattttaaagcaaacctggatgccataatcaagatccaggcctgggcccggatgtgggcagctcggaggcaatacctgaggcgtctgcactacttccagaagaatgttaactccattgtgaagatccaggcatttttccgagccaggaaagcccaagatgactacaggatattagtgcatgcaccccaccctcctctcagtgtggtacgcagatttgcccatctcttgaatcaaagccagcaagacttcttggctgaggcagagctgctgaagctccaggaagaggtagttaggaagatccgatccaatcagcagctggagcaggacctcaacatcatggacatcaagattggcctgctggtgaagaaccggatcactctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccagactcagcccatctacctggccaagctgatctttcagatgccacagaacaaaaccaccaagttcatggaggcagtgattttcagcctgtacaactatgcctccagccgccgagaggcctatctcctgctccagctgttcaagacagcactccaggaggaaatcaagtaggctctccagacacaaaggaatggggagagaatgggttaagagatccccctgttggctccttcacaaggtgacaacttgttgaggcctaagggtagaaatggaatcagaagacctcttttctctacctcctgtggagaaaccgtaaaacatctgggacagcacagtgggaggatatgggctgacatgctaacacaaaggatgagagagatatcaagacattccttaagagcggggacaccagggcaggctttgagagccaaaatctcaaaaaggaaaagcaacggtatgtcctacacagaggcagaagactggtttcaatgacctcttaaaccacaggtcaaaggtggagcagccccaggacgtggtgacaggcaacccaacagtggtgaggctggtggtgagattctaccgtaatgggcggggacagagtgccctgcaggagattctgggcaaggttatccaggatgtgctagaagacaaagtgctcagcgtccacacagaccctgtccacctctataagaactggatcaaccagactgaggcccagacagggcagcgcagccatctcccatatgatgtcaccccggagcaggccttgagccaccccgaggtccagagacgactggacatcgccctacgcaacctcctcgccatgactgataagttccttttagccatcacctcatctgtggaccaaattccgtatgtgcaacagccccaccccagcctacgcatgggatttcaagagggccaggccaccatggggagcagagcagggtgatagtcctgcagggaggaaggcagggagggagatggagccaggggtactcagaggggttcctgaagagatgtggggaatgctcgaagctcctgctagagagctgagctgagagacggcgtgcaagtctgtgtgtggcctggtaggatgtcagtggaaccagaggagggaccctaaaatgatctcagggacactttattagctaagagcaaatgaggagaaaatgggactcttcagttcccaatatcaaaaataaatattttaagcccaaaaaaaaaaa

SEQ ID NO: 405356 - DNA, 231 bp, Homo sapiens
gcactgattctagaccgtatgttctgtgccctgggatggcctaggctagttgtatcacccgctcctccacccctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccag

SEQ ID NO: 405357 - DNA, 1645 bp, Homo sapiens
tcagctgtcaccaaggtcactgctgcctatgaccgccaacagctctggaaagccaacgtcggctttgttatccagctccaggcccgcctccgtggcttcctagttcggcagaagtttgctgagcattcccactttctgaggacctggctcccagcagtcatcaagatccaggctcattggcggggttataggcagcggaagatttacctggagtggttgcagtattttaaagcaaacctggatgccataatcaagatccaggcctgggcccggatgtgggcagctcggaggcaatacctgaggcgtctgcactacttccagaagaatgttaactccattgtgaagatccaggcatttttccgagccaggaaagcccaagatgactacaggatattagtgcatgcaccccaccctcctctcagtgtggtacgcagatttgcccatctcttgaatcaaagccagcaagacttcttggctgaggcagagctgctgaagctccaggaagaggtagttaggaagatccgatccaatcagcagctggagcaggacctcaacatcatggacatcaagattggcctgctggtgaagaaccggatcactctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccagactcagcccatctacctggccaagctgatctttcagatgccacagaacaaaaccaccaagttcatggaggcagtgattttcagcctgtacaactatgcctccagccgccgagaggcctatctcctgctccagctgttcaagacagcactccaggaggaaatcaagtcaaaggtggagcagccccaggacgtggtgacaggcaacccaacagtggtgaggctggtggtgagattctaccgtaatgggcggggacagagtgccctgcaggagattctgggcaaggttatccaggatgtgctagaagacaaagtgctcagcgtccacacagaccctgtccacctctataagaactggatcaaccagactgaggcccagacagggcagcgcagccatctcccatatgatgtcaccccggagcaggccttgagccaccccgaggtccagagacgactggacatcgccctacgcaacctcctcgccatgactgataagttccttttagccatcacctcatctgtggaccaaattccgtatgtgcaacagccccaccccagcctacgcatgggatttcaagagggccaggccaccatggggagcagagcagggtgatagtcctgcagggaggaaggcagggagggagatggagccaggggtactcagaggggttcctgaagagatgtggggaatgctcgaagctcctgctagagagctgagctgagagacggcgtgcaagtctgtgtgtggcctggtaggatgtcagtggaaccagaggagggaccctaaaatgatctcagggacactttattagctaagagcaaatgaggagaaaatgggactcttcagttcccaatatcaaaaataaatattttaagcccaaaaaaaaaaa

SEQ ID NO: 405358 - DNA, 421 bp, Homo sapiens
cagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtgggtgactgggggcagcgcgccccaacctgccctgtcctggaggcccctgcagcctcaggactcctagactagttggcactcccctgttccctgctgcctggctggggagggaatcagtgtcccaggagtgagggacactcctctgcccccagggtcctcagggcggtagggcgggatggacacagcattcggggttggg

SEQ ID NO: 405359 - DNA, 180 bp, Homo sapiens
caagaatgaattcagttaaaggtatttagggttcaaagaagacaaactgtacaagcccatttcattccttgttgtatacctttccatctgccctcccattttaactatctactgtggcctttttatggaaacagagcaagatcaatgaaggctaatggcaagaataagaaaaagagttga

SEQ ID NO: 405360 - DNA, 469 bp, Homo sapiens
gagctttcgtctcaacacaagtcaggcctcttctttagcaaatggctgagacggggctagggaaatcttgatcacacccattaagtgattcgaaagcgttgcaagtcccctgagcctggtacagcctggacccgtgtttctaggcgaatggatgagatattctgtcttgccgtgtgctaaattggacaggttcaggggaagataatttgtataaaaaggtagttctttactgctaactgccaaacttctgcaatcaaaaacacccgtagcagtaacttgacctaggttaaaaaagtgtgtggatgacaagctcagaaggaatatacaagcaactggaacaaggctttgacttaaaggtttggcgttgtttaaaagcagccccgtatacatattgtgttatgtatatgtattgaatgctgtatttttgctgaattaaagcacacttcaccgacagacgtttgtggttaaa

SEQ ID NO: 405361 - DNA, 242 bp, Homo sapiens
gcacttgggtcaggttgcagtcagacattgtcagcagcatcttacctaagaaggtcaggatagttcatttattttggggggcagttaagacatcagctgtccagcagtctcccttatcaggagcacagctaggaaccagtgaataagcaaaatgagaatctcaggctggccagcaaagatatcccaatgtccatcccttgtcctgctggctgcctgcctgccccagtctttcactggcaact

SEQ ID NO: 405362 - DNA, 284 bp, Homo sapiens
gtgtctgtgtgctgccgaatgaagctcaagtggctggatccagctccgaaggccagaagctctaagcagccccttctacaccacaccacccacttcctaatgttgtttttcccaccggcggtggactctgactctgggtggccttgggggtcctggagcttaagaccatgcagaagctgtcactcgggagaccagaagttcagaagtaggagctgcagccgcctgggtctgtggttcttggctgccccgagaggcagttcctctgcttggggagaaagcagggt

SEQ ID NO: 405363 - DNA, 316 bp, Homo sapiens
gtatttacatgttgattttacagatggtgaatctgaggcataggaaggtaaagcaacttgcttacaatcatatgctattaagtgatatcctatattctgcctatcttatccctattttaggtctgttttaataacctcaccccttgcaaagttgggtcatgtcctgggaatcgcaattccaaggactgcttcctgccagatttccaacttgcctagactgcatctctcctctgacctaaagacctcctagtacctgcttgggcttcctcacaaacacaccaccaaatgaacacagctactgccaattatcctccaa

SEQ ID NO: 405364 - DNA, 499 bp, Homo sapiens
catatcaacggatgccgtggagctcggtcttctgcaggaactaaagagcctgtggtttcgattcccagccggaaactgtcttgggtacaggtcccttacagcgtctggctgtaatggctccggaaaacctggggaagggaagggggcctcctgggctctcacctgacacaactaagggaatctgggttagatggtgaaaggaagagaaggttcagagggcggctgtgcgcctgcgccgggcgcggcggctcacacctgtaatcccagcacgttgggaggccgaggcaggcggatcacgaggtcaggagatcgagaccatcctggctaacacggtgaaaccccgtctctactaaaaatacaaaaaatgagccgggcgtggtggcgggcgcctgtagtcccagctacttgggaggctgaggcaggagaatggcgtgaacccgggaggcggagtttgcagtgagccgagatcgcgccaccgcactccagcctgggcgacaga

SEQ ID NO: 405365 - DNA, 216 bp, Homo sapiens
cattcaacaccctcaacacattccagctacatcaaaagagtctggttcctaccttctggccttaggataatgacagaatgtagtacatcctaagttccagagagttaccaaaaacagagacagcattctggacaaacacaaagattagagaagcaccttaaatctttggccagatggattcgtgagatccttctactacactaggcaagactggga

SEQ ID NO: 405366 - DNA, 412 bp, Homo sapiens
gaagaaggaaccaggcaagggaaggttggggtatattggtttaggctcccctagaagcagactttgagccggaagtgggagtgtaaataagtgtatttgggagaggatcccaagaaacaccatcggaggagtgggaaatgagggggaagaggagcagtcattgaagggtgccgggtaaaacacgcatcttggattttggttgctgagagagtcagtcttttttctcatcttaaaatatctggacaaggaagtggctaggattattgtgggagaaactagctcatcggtggttctgggatttgaacccaggattctcggccagcattccagcaacagggactgatatgttttggctgtgtccccacccaaatctcatcttgaattgtagctcccatcattctctggggctttt

SEQ ID NO: 405367 - DNA, 202 bp, Homo sapiens
caggcctgagccaccacacctggctgaatataagtactttcttaacagatctgagtagtttttaaatctgtgcatgtggatgatagtaggaaacaaataataaaatgttttagtgaataatgtagaaaaatctaaatccacagaacacttggtaaatagccctgttaatataaaaatttaggggaaaaaactggaaagaata

SEQ ID NO: 405368 - DNA, 479 bp, Homo sapiens
agaaaacacagaagggcaccaacacagcataagcacaagtcaggggaggctgtgacatcagatgggcgctgaatgcgtggctgggaggacaggcaaggcccaaaggagtagctctctgttgttactgttgtgctcttcatggataaatttgttctacagcagtttttaagattctattatatgtggagtaccatttatgaggatacaaaatacaaataagaggatgtcctcaagttggatacagatagtgaaacaaaatttacaaataattacacaataacatgacgaagtctatagtggagccaaacaaaaaggactgcaggaacactaaggggtaagctaaaaatcctgcctgagagaattaagaaaggcttctcagaggagataacatttgagctgggtcctcaagaatgaacaggaattctccagtgggaaaggtcactatgaatgcaatgattagaactacttagtaagcgtac

SEQ ID NO: 405369 - DNA, 4787 bp, Homo sapiens
tctcactatagggctcgagcggccgcccgggcaggtctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaa

SEQ ID NO: 405370 - DNA, 701 bp, Homo sapiens
ccacattgcaggagccttaagtatgtaatggttattatagtttcactgattttcattttgacttagatgtaaatctgttttgaatgtttctagttaacatccatcagaaggaaggtatacatgtgcctgcaggtagaacatttgcataatatagattgctaaattatttagtgaaaaatagtttagtaatatttctctattgtcagcatcttaggaatcttttggctaatgaggcattataaagtgaatcttcagcaccgactttctgtttcatcttttctaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactagtaagtcaatggtcttcagatagtttatgtgtattgtggccaaatttttggataaatttgctgagggttgtgtgatttctcagattgttgagaatataatgaatatccttttagaatcagatgaatttgggaaaatgcatctcaatacatgcaagcgtggacccccacattgtg

SEQ ID NO: 405371 - DNA, 207 bp, Homo sapiens
tcgcgcacacatcactgctagtggctctccagaagaatggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcct

SEQ ID NO: 405372 - DNA, 6271 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405373 - DNA, 5992 bp, Homo sapiens
attgatgacctcccacaactggagcagccgggaacagctctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405374 - DNA, 6115 bp, Homo sapiens
attgatgacctcccacaactggagcagccgggaacagctctgaccacagtggttccggggagaagcctttccaggacccatgtgtaggcacaactgttttccctgatcaggatacttgcggcactcaaatactttcccagcaacatctagactgctgtttgaccaaacaacggggctccaacagcctagccaagtgaaacataaaactaaccatcacagtatccttgtcaaaaatcagtctgacaacacatcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405375 - DNA, 6131 bp, Homo sapiens
tgtaagatacttgctgtaagtagcaaaaagatgggaaggaaagtctacagaccaaatcatatctgaatctccccattctccctctccacaaatattggtttaggaattctccgaagtttgaaggttatgaatggttatcactcaaggattcagaactaagcagaggaaagaaattcctaagggaacactgctcagaaagtactgcagcatgtcttcaaatgcctgaggatcaagttggaaaactagaagcaacagaaaacacaataagccccaggcgtgagtcactggagagcgcgacgggaggaaggggcgccctgagtccacagccctgggggaggtcggagggtctgaaagcgagaagtccgtgagtagaagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405376 - DNA, 6059 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgcaaaaaaaatgataataaataaggggggtgcttac

SEQ ID NO: 405377 - DNA, 4495 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactca

SEQ ID NO: 405378 - DNA, 4687 bp, Homo sapiens
gtgggtgaccgtggcttgtgggttgaccgtggcttgtgggttgaccgtggcttgtgggttgaccgtggcttgtgggttgaccgtggcattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405379 - DNA, 4069 bp, Homo sapiens
aaacacaaaactagggctaggtacgaggcccgtgttaattcggccgaggcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405380 - DNA, 3932 bp, Homo sapiens
  misc_feature (17)..(17): n is a, c, g, or t
  misc_feature (37)..(37): n is a, c, g, or t
tacggcgccccccggtngcgacgcgacggcgccgcgnccggggcggcgcgtgcccgccaggcgggccacgcacgctccgcggccggggcccagcgcgacggctcctacgcccgcgtgcccgcgaaccagactgggcaccggcgctgcgacggcgggcccgggaccgggggatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405381 - DNA, 5876 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcattagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405382 - DNA, 3938 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctccaaaaaaaaaacagaacacaaacaaagcaaagcacaagggcagaaaacccacggagccccacaaaaa

SEQ ID NO: 405383 - DNA, 3097 bp, Homo sapiens
ttcggcgtattaaatgaggctgactacagtgttctatgacatcatcagagatgcataatccccattgtctgtctgcccatggtctatgtggacaaatgaggttgacaattaatagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405384 - DNA, 4005 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagggtaagctgatttggttgaattggggagggggagataaaacctttttttctttgtagtcctctatgagaagaaactagaaatctaatgagctaaggaattttatttttatattttcatagtctcttgtctccaagcctcaaatggattatacttaatgtaatccatccgtatgtacttattatttattagaattaaaaccttcatcttaggacattttgagcttaccagttggtgcttaacacaagcttatgtgtagtttttctgcctatcttaagaaa

SEQ ID NO: 405385 - DNA, 2944 bp, Homo sapiens
tagtgtcagatatgtacactcaatattcagtagctacaaagaaaaggtgttaccatggtttgaacagactacaagatgaggatgataatgatgtttatattctgaccaaagtgtcagatattttacactcaatattcagtagctacaaagaaaaggtgttaccatggtttgaacagctgcttccattaattgtcaacctcattagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405386 - DNA, 3642 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtgtcgctatatagcgacaccgtacagttgtaaattcgagaatacccgccaatctccctcaggtttaataattcgttagaataattcacacaatataggaaaacactttacttacatttagcaatgcatcgtaaaggatacaactcaggaacagctaagtggaagagatgcaccgagaaaagtatgccctgggtgggggtagaaggtggaggaagatatagagtttccatgccttctcctggttggcaccctcctaacaccaattttttcaccacctatgaagctgtccatgccctattagttaggggggtcttgcg

SEQ ID NO: 405387 - DNA, 2596 bp, Homo sapiens
cttccaaatgagcatttcgtcctaagtctgtgaaaatgtttctttccctagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405388 - DNA, 3025 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagaatttatactgttaaaaagatatataaagttcgtataaacaggcttgagaccactttgatgt

SEQ ID NO: 405389 - DNA, 2025 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgcttggccgagaggaactgtgatctttttctcgttcaacatggtgctgtcgtgttggagaagtcacatttctaatacaaggagtgagctgagagctccgttctttcatgagatgaatctcgtgatctgtcacttgaccttcgtctatctcttgatctctcatgtccctccacctagcacca

SEQ ID NO: 405390 - DNA, 1963 bp, Homo sapiens
ttgaatacaaaagaggagtgaatgagagactactgccagacatgccaatgacacttcacattcaagggctggaagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgcaaaaaaaatgataataaataaggggggtgcttac

SEQ ID NO: 405391 - DNA, 165 bp, Homo sapiens
agcagctgcatatggcctgggagtcatggcacagtacggtggagataattatcgccctttttgtacaggtacgtttgcttattccgttacgtgcatttcattccagacatcctgtgaatccctactttactctctttaccacactcccaaacattatttgcctat

SEQ ID NO: 405392 - DNA, 403 bp, Homo sapiens
caggaggtatgtcttttctatttttatacatgctttatatttaacacaagctcttgggtatcttagataaacagaagttgcctagcactccttttagtgcattgaaccctttaacatttaagcaaaataataaacagtcttttgaggttccttaacaatgaaacgtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaaggtgaatatttttctcttaaaaaatatgtataaggttgtatgttcatttattagtcttgctaaaagt

SEQ ID NO: 405393 - DNA, 6320 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgcaaaaaaaatgataataaataaggggggtgcttac

SEQ ID NO: 405394 - DNA, 6096 bp, Homo sapiens
tctcactatagggctcgagcggccgcccgggcaggtctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagccccaggcgtgagtcactggagagcgcgacgggaggaaggggcgccctgagtccacagccctgggggaggtcggagggtctgaaagcgagaagtccgtgagtagaagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405395 - DNA, 5915 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgcaaaaaaaatgataataaataaggggggtgcttac

SEQ ID NO: 405396 - DNA, 6217 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgaaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405397 - DNA, 5366 bp, Homo sapiens
ccacattgcaggagccttaagtatgtaatggttattatagtttcactgattttcattttgacttagatgtaaatctgttttgaatgtttctagttaacatccatcagaaggaaggtatacatgtgcctgcaggtagaacatttgcataatatagattgctaaattatttagtgaaaaatagtttagtaatatttctctattgtcagcatcttaggaatcttttggctaatgaggcattataaagtgaatcttcagcaccgactttctgtttcatcttttctaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405398 - DNA, 4906 bp, Homo sapiens
aaggctaggtgcgaggctgggtttaatcggccgaggagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405399 - DNA, 6127 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405400 - DNA, 3579 bp, Homo sapiens
  misc_feature (22)..(22): n is a, c, g, or t
aaactagctaggtacgaggcgngtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacggcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaat

SEQ ID NO: 405401 - DNA, 3870 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcct

SEQ ID NO: 405402 - DNA, 3829 bp, Homo sapiens
  misc_feature (41)..(41): n is a, c, g, or t
  misc_feature (3745)..(3745): n is a, c, g, or t
  misc_feature (3779)..(3779): n is a, c, g, or t
  misc_feature (3794)..(3794): n is a, c, g, or t
  misc_feature (3807)..(3807): n is a, c, g, or t
  misc_feature (3825)..(3825): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagtacaaacttctggaaggantgttgggactgaattgcattaaccacagctccantccctgaaccaacanggccgccctttcnaggaactccctgaaactnctgc

SEQ ID NO: 405403 - DNA, 3633 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgattggtgtgcagcagagctgcaatcaccttctcatgaaatttcttttggataccaggtgcaaaatctgtagccatctgtccacggcattacaggctgcatacct

SEQ ID NO: 405404 - DNA, 2453 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaagagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcct

SEQ ID NO: 405405 - DNA, 1010 bp, Homo sapiens
  misc_feature (41)..(41): n is a, c, g, or t
cgtacccatatccgcagcaggtctccaaggtgaacagcttntgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggtatatacattaatctagtttttt

SEQ ID NO: 405406 - DNA, 239 bp, Homo sapiens
  misc_feature (78)..(78): n is a, c, g, or t
  misc_feature (142)..(142): n is a, c, g, or t
tgggtatgtacacacacacacacacacacacagtcatacatatgcaacaataagaaaaacaaaatttagaaaaaaaanttctgcctataataataggatttgtatgggatggttacagacacataaacatacttgtataggnccaaactggctccattttttggcaagaaaatataaaataaaattagaataatagagtacttatggcagacatagggtaaagccatactcatgtcctt

SEQ ID NO: 405407 - DNA, 450 bp, Homo sapiens
aaaaagtatcttcacactttacattgaaaaaaatcagttacatggtcttatttagcaagttatggtaaaaattatctctatgactatctttttggttaaggtaatctataatggatactttactgttaccatatggcatactaaatccaatcagtcaatattgtgttgaaattattatattaaacataattctctaactaaaaatgaatactgttacaatatatttctcttacaagttttaaggaattacttaatagtgaatatgttctccgaatcatataaaactgtgtttatgtggtaaaactttaaaattcacccagttcttagatgagtaatttcttcaatcttctaatgtaaaacaatcacattttcttattaaagggaagttctatctggcgaaatagtttgaaaaggtcaaaacaaaacacaactgtttctcaaacaaacaaa

SEQ ID NO: 405408 - DNA, 1120 bp, Homo sapiens
ggggaaataacgaaaaggattattaaatcttatgcgggtatctactggaggttgagcgtacatgctggcaacgtccccagttaaaggatctatgggagttaggataggtcaataattggggagagaagcactcactcactcccctacacctcagacatacttgaaactcagaaacagcactgagtctccccatttctcagccccagctgctgggcctccaaggttgggctgaggatggagttttggctctgggtttgccctgactcctgctggaagacgctgccctggtttttcaccctctagtggccttggacattgagtatttgtagaaatgcagattacattgcaaatggaaacctttgccaggaagacacatgcattttgcttttaattctttgagacatttgattttgtcttagggactgacctttcagcatcaaagaaatacatatctactgtatccgccaaagtttgtgatgcctgcatagacgcttacttgtaaaaaaaaaaaaatacaaaaaaatacaaaaaaaccaacaacgaaaaaccacaattgaattgcctttgaaagtgggagatgatctgtctccaacggattgaaaaaaaaaaatgcttcttaaaaaatgtgtatgttttgtattctttttttctagtagaaaataactgacttgaaatattggtggtttttttcttagtgacgtgtgttgcttttgtgtgtaataatatttgaatgtaattacagcagtgccaatttgccaaagatgttggacatatttttcttttttggggaggagggcagggctaggggtgggacttgggagaaaacaggggtgggcttttggtttaattttttttttacttttttttccttgtcaaacctgaaatttgtggcttccttttaagttaaatggttgactgcaacacctttattttagattagttggagaaacatgcaataagattggcgtagtttcaatatctgtgtgtcttttcatgagtggctgttacttgtgaagaattgattttatgtaacctttatgtgagataattatttgtaaatatttgccataattttattggttcctaaaataaaagtaattttttaagttcagaaaaagaa

SEQ ID NO: 405409 - DNA, 8918 bp, Homo sapiens
agcactgctgctctcccggcttcccgctctactccggccgggccgggtccgccacgtctggcgcgctgagcaggcccggccgcgcagcgcctaccctttcctcgctccgggccggcagtgtggggcggcgcgctgggggcgcggcgtgtctggggacatcttgtgatgttggcgagaacaggacatgatctcacatggcgagaagctctttagttccttaatcatttcacggtgccttcggacgctttttttccacctaaaacgtttagtttcagctcagtgatcagctaccccagctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaagcagacttcctctggccaccgctaagtattttgttccctaagtcccccacagggtggtggaacagaagagaaaactaaggctcagcaaggtggagtcctcaagcagtgactggtgggggtggggctgggactcgggctcctgacccccaacccatggtgttccctgtcaccctggtctatccacatctcctattcctgaggagagttgacagtaagagcagtgagagatggttctgggccccatgccctagacaatcagtctgtaagaactgccaaggaagcctggtcacccaggccagggatggagcccagcgagctcacagcaggcacatgcacccccgcccccacccagaacctgcggggcaaagaagggaggtagttggggccagagtccacctccaggagccagggtgagctggctgcagcttccacctgtcaggtaaggtaggagaaggtatgttacctggcatctctctccctgcctccctccatttagcaggaagtggtggggtcaggggtcttcagcacagacttcttgagcctctgccccctgtcacccttcttttggaatgatgtgtacccacatctttggatcctgccctccttgtggttccaggctgttgggaggaggtcagcctcccctgaaccagctgcctgaggcatgcagcatccttcctcggcaaagcccacctggctcacagcggccccctctccccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccaaggtcatgtgctgtcccccacttccctttctttgccttcccactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagtatgaaaacttgtaaaattttctgtcggcctaaagaaaaatgtccatgggccaaacttgacccactgggcaccagcctgtgagccccaatgcctgtcaattgccccctttctcattcacctcctgtcctttgttgcagatttggaggagatgggagcccagagaggtgagagatgtgcttcagggtgtccagcaaggcaggggtagaaacgggcacgcccagagcctgccactctcccaggcctcatcttgggctcttgcaagccttgcgctttgaagatggagttgggtggaaggtcagaggcgctggggacgggattggggagctgctgggttttcaggggaggtcagtgctgcttgggcacctttcacatgtgcagggaagagactcagatgtggccacagggcactgaggggtgaaatccatttaccagaagtcacgctccagaacgactgcccagccttggcagccagtggctccagccaccccctcctcatgacattcagccagaattgagctccaagccaggaagcaaatcttaaaaaccaaccaagcaccctgacacagccctagaaacacgatgagtctgaaatacagcttcccaggaggggagtctaagatacagcttcccgggagggtggaaaccaactcctgccccacggcaggccaggcccaggcaggcatgggtggatcccacagggctctgagctagaccggctccacggtggccccactacgaggccagttctgcagtcttggccttgtcacccatcgagaggctgctctgatggttcccagccacacaccagctctcctggggaaactatttctttcgttcttttggcctcggagaggtccgaggcaagtacatttcttaaaaggtaataaaatgcattattggaaagttggacagtcaggccacgactcctagcccacggcgtgccccacctcccagcagccccttcagccccttgcccctgttgccccaaacctcagggttccctcttgcatattcatgggggaaccacagtgctgatgtgcacttccccactgtcagctcggctgcacctcgtgtggcgccaggtcccaagggcctctgcagaggccaggctgtgagccccttgcctgcctgctcccctgatgaggcaacagcttctctgaaatgagctgccggccaggagcaggcaggcaccagcctgtctttccttttctggtaattcctcagcactgaggctccgttcctgggcaccccaggattgaagggaacctcagaatcatgtcactgccattctagagtttcaatccaaggggtcccctttagctcatctccaagatgggtaaacgtagccaccattcagaaagcccagaaattcttgttcccacatcttagacccctgagcaacacaaggagaaaatgcagctgcttacctattaatatctactgagggacaatcagcaaagcctcaaaggagtcgtctcaggtagggtacttggcctgtggcaggagagacagaggcacaaacccacccacccatcagcttccggtggctgatcggggcccagggagggaagcaggtgaaacagcagggtgggggtgacttggcagtcatgcatctcctccccgactctgaggcctggcaggaggaggccacaccagcctcacctgccctgacccccgccccccaccctgtgaccctgtggctatggccgctggtcgcccttgtccccaaaatcaccatgcctgtggccacgtccctcatcttctccaaaagcatcattaagaacaagtgattttggatgatggatttttgatttacaaacggcgcatttcccttggagtggaacagaaaggaaaccatttaatggcgcccttcttttcaagcatgaatacattttaatgaaactattttattgtatttgaggaaatggagagttgaacattccaaccaatcaatagccaattaattgctataaagctaaaaagaaaataaataaatcctgagtctattttaaacactgcaaaaagttcagagcctcagaatctggccttcccctcccataaggtgcacgagcatgtaaacacacacacacacacacacacacacacacacacactcactcactcccctacacctcagacatacttgaaactcagaaacagcactgagtctccccatgccaattcttgcctgctgtcttcgacttgggtcagagaaggtgagcagacccggcagcagcctgtcccggggctcaggaagaggcaggcccatcccctggccccaagcacccagcacaacagagggtggcgggcagtgagggcctggcgttgcctgggccccacttctcagccccagctgctgggcctccaaggttgggctgaggatggagttttggctctgggtttgccctgactcctgctggaagacgctgccctggtttttcaccctctagtggccttggacattgagtatttgtagaaatgcagattacattgcaaatggaaacctttgccaggaagacacatgcattttgcttttaattctttgagacatttgattttgtcttagggactgacctttcagcatcaaagaaatacatatctactgtatccgccaaagtttgtgatgcctgcatagacgcttacttgtaaaaaaaaaaaaatacaaaaaaatacaaaaaaaccaacaacgaaaaaccacaattgaattgcctttgaaagtgggagatgatctgtctccaacggattgaaaaaaaaaaatgcttcttaaaaaatgtgtatgttttgtattctttttttctagtagaaaataactgacttgaaatattggtggtttttttcttagtgacgtgtgttgcttttgtgtgtaataatatttgaatgtaattacagcagtgccaatttgccaaagatgttggacatatttttcttttttggggaggagggcagggctaggggtgggacttgggagaaaacaggggtgggcttttggtttaattttttttttacttttttttccttgtcaaacctgaaatttgtggcttccttttaagttaaatggttgactgcaacacctttattttagattagttggagaaacatgcaataagattggcgtagtttcaatatctgtgtgtcttttcatgagtggctgttacttgtgaagaattgattttatgtaacctttatgtgagataattatttgtaaatatttgccataattttattggttcctaaaataaaagtaattttttaagttcagaaaaagaa

SEQ ID NO: 405410 - DNA, 7629 bp, Homo sapiens
agcactgctgctctcccggcttcccgctctactccggccgggccgggtccgccacgtctggcgcgctgagcaggcccggccgcgcagcgcctaccctttcctcgctccgggccggcagtgtggggcggcgcgctgggggcgcggcgtgtctggggacatcttgtgatgttggcgagaacaggacatgatctcacatggcgagaagctctttagttccttaatcatttcacggtgccttcggacgctttttttccacctaaaacgtttagtttcagctcagtgatcagctaccccagctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaagcagacttcctctggccaccgctaagtattttgttccctaagtcccccacagggtggtggaacagaagagaaaactaaggctcagcaaggtggagtcctcaagcagtgactggtgggggtggggctgggactcgggctcctgacccccaacccatggtgttccctgtcaccctggtctatccacatctcctattcctgaggagagttgacagtaagagcagtgagagatggttctgggccccatgccctagacaatcagtctgtaagaactgccaaggaagcctggtcacccaggccagggatggagcccagcgagctcacagcaggcacatgcacccccgcccccacccagaacctgcggggcaaagaagggaggtagttggggccagagtccacctccaggagccagggtgagctggctgcagcttccacctgtcaggtaaggtaggagaaggtatgttacctggcatctctctccctgcctccctccatttagcaggaagtggtggggtcaggggtcttcagcacagacttcttgagcctctgccccctgtcacccttcttttggaatgatgtgtacccacatctttggatcctgccctccttgtggttccaggctgttgggaggaggtcagcctcccctgaaccagctgcctgaggcatgcagcatccttcctcggcaaagcccacctggctcacagcggccccctctccccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccaaggtcatgtgctgtcccccacttccctttctttgccttcccactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagtatgaaaacttgtaaaattttctgtcggcctaaagaaaaatgtccatgggccaaacttgacccactgggcaccagcctgtgagccccaatgcctgtcaattgccccctttctcattcacctcctgtcctttgttgcagatttggaggagatgggagcccagagaggtgagagatgtgcttcagggtgtccagcaaggcaggggtagaaacgggcacgcccagagcctgccactctcccaggcctcatcttgggctcttgcaagccttgcgctttgaagatggagttgggtggaaggtcagaggcgctggggacgggattggggagctgctgggttttcaggggaggtcagtgctgcttgggcacctttcacatgtgcagggaagagactcagatgtggccacagggcactgaggggtgaaatccatttaccagaagtcacgctccagaacgactgcccagccttggcagccagtggctccagccaccccctcctcatgacattcagccagaattgagctccaagccaggaagcaaatcttaaaaaccaaccaagcaccctgacacagccctagaaacacgatgagtctgaaatacagcttcccaggaggggagtctaagatacagcttcccgggagggtggaaaccaactcctgccccacggcaggccaggcccaggcaggcatgggtggatcccacagggctctgagctagaccggctccacggtggccccactacgaggccagttctgcagtcttggccttgtcacccatcgagaggctgctctgatggttcccagccacacaccagctctcctggggaaactatttctttcgttcttttggcctcggagaggtccgaggcaagtacatttcttaaaaggtaataaaatgcattattggaaagttggacagtcaggccacgactcctagcccacggcgtgccccacctcccagcagccccttcagccccttgcccctgttgccccaaacctcagggttccctcttgcatattcatgggggaaccacagtgctgatgtgcacttccccactgtcagctcggctgcacctcgtgtggcgccaggtcccaagggcctctgcagaggccaggctgtgagccccttgcctgcctgctcccctgatgaggcaacagcttctctgaaatgagctgccggccaggagcaggcaggcaccagcctgtctttccttttctggtaattcctcagcactgaggctccgttcctgggcaccccaggattgaagggaacctcagaatcatgtcactgccattctagagtttcaatccaaggggtcccctttagctcatctccaagatgggtaaacgtagccaccattcagaaagcccagaaattcttgttcccacatcttagacccctgagcaacacaaggagaaaatgcagctgcttacctattaatatctactgagggacaatcagcaaagcctcaaaggagtcgtctcaggtagggtacttggcctgtggcaggagagacagaggcacaaacccacccacccatcagcttccggtggctgatcggggcccagggagggaagcaggtgaaacagcagggtgggggtgacttggcagtcatgcatctcctccccgactctgaggcctggcaggaggaggccacaccagcctcacctgccctgacccccgccccccaccctgtgaccctgtggctatggccgctggtcgcccttgtccccaaaatcaccatgcctgtggccacgtccctcatcttctccaaaagcatcattaagaacaagtgattttggatgatggatttttgatttacaaacggcgcatttcccttggagtggaacagaaaggaaaccatttaatggcgcccttcttttcaagcatgaatacattttaatgaaactattttattgtatttgaggaaatggagagttgaacattccaaccaatcaatagccaattaattgctataaagcta

SEQ ID NO: 405411 - DNA, 4630 bp, Homo sapiens
cacgaggagaaggcccatggagaaatgccccaggccttctgccacgatgctggtgaggccccggacttgtgttttccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccaaggtcatgtgctgtcccccacttccctttctttgccttcccactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagtatgaaaacttgtaaaattttctgtcggcctaaagaaaaatgtccatgggccaaacttgacccactgggcaccagcctgtgagccccaatgcctgtcaattgccccctttctcattcacctcctgtcctttgttgcagatttggaggagatgggagcccagagaggtgagagatgtgcttcagggtgtccagcaaggcaggggtagaaacgggcacgcccagagcctgccactctcccaggcctcatcttgggctcttgcaagccttgcgctttgaagatggagttgggtggaaggtcagaggcgctggggacgggattggggagctgctgggttttcaggggaggtcagtgctgcttgggcacctttcacatgtgcagggaagagactcagatgtggccacagggcactgaggggtgaaatccatttaccagaagtcacgctccagaacgactgcccagccttggcagccagtggctccagccaccccctcctcatgacattcagccagaattgagctccaagccaggaagcaaatcttaaaaaccaaccaagcaccctgacacagccctagaaacacgatgagtctgaaatacagcttcccaggaggggagtctaagatacagcttcccgggagggtggaaaccaactcctgccccacggcaggccaggcccaggcaggcatgggtggatcccacagggctctgagctagaccggctccacggtggccccactacgaggccagttctgcagtcttggccttgtcacccatcgagaggctgctctgatggttcccagccacacaccagctctcctggggaaactatttctttcgttcttttggcctcggagaggtccgaggcaagtacatttcttaaaaggtaataaaatgcattattggaaagttggacagtcaggccacgactcctagcccacggcgtgccccacctcccagcagccccttcagccccttgcccctgttgccccaaacctcagggttccctcttgcatattcatgggggaaccacagtgctgatgtgcacttccccactgtcagctcggctgcacctcgtgtggcgccaggtcccaagggcctctgcagaggccaggctgtgagccccttgcctgcctgctcccctgatgaggcaacagcttctctgaaatgagctgccggccaggagcaggcaggcaccagcctgtctttccttttctggtaattcctcagcactgaggctccgttcctgggcaccccaggattgaagggaacctcagaatcatgtcactgccattctagagtttcaatccaaggggtcccctttagctcatctccaagatgggtaaacgtagccaccattcagaaagcccagaaattcttgttcccacatcttagacccctgagcaacacaaggagaaaatgcagctgcttacctattaatatctactgagggacaatcagcaaagcctcaaaggagtcgtctcaggtagggtacttggcctgtggcaggagagacagaggcacaaacccacccacccatcagcttccggtggctgatcggggcccagggagggaagcaggtgaaacagcagggtgggggtgacttggcagtcatgcatctcctccccgactctgaggcctggcaggaggaggccacaccagcctcacctgccctgacccccgccccccaccctgtgaccctgtggctatggccgctggtcgcccttgtccccaaaatcaccatgcctgtggccacgtccctcatcttctccaaaagcatcattaagaacaagtgattttggatgatggatttttgatttacaaacggcgcatttcccttggagtggaacagaaaggaaaccatttaatggcgcccttcttttcaagcatgaatacattttaatgaaactattttattgtatttgaggaaatggagagttgaacattccaaccaatcaatagccaattaattgctataaagctaaaaagaaaataaataaatcctgagtctattttaaacactgcaaaaagttcagagcctcagaatctggccttcccctcccataaggtgcacgagcatgtaaacacacacacacacacacacacacacacacacacactcactcactcccctacacctcagacatacttgaaactcagaaacagcactgagtctccccatgccaattcttgcctgctgtcttcgacttgggtcagagaaggtgagcagacccggcagcagcctgtcccggggctcaggaagaggcaggcccatcccctggccccaagcacccagcacaacagagggtggcgggcagtgagggcctggcgttgcctgggccccacttctcagccccagctgctgggcctccaaggttgggctgaggatggagttttggctctgggtttgccctgactcctgctggaagacgctgccctggtttttcaccctctagtggccttggacattgagtatttgtagaaatgcagattacattgcaaatggaaacctttgccaggaagacacatgcattttgcttttaattctttgagacatttgattttgtcttagggactgacctttcagcatcaaagaaatacatatctactgtatccgccaaagtttgtgatgcctgcatagacgcttacttgtaaaaaaaaaaaaatacaaaaaaatacaaaaaaaccaacaacgaaaaaccacaattgaattgcctttgaaagtgggagatgatctgtctccaacggattgaaaaaaaaaaatgcttcttaaaaaatgtgtatgttttgtattctttttttctagtagaaaataactgacttgaaatattggtggtttttttcttagtgacgtgtgttgcttttgtgtgtaataatatttgaatgtaattacagcagtgccaatttgccaaagatgttggacatatttttcttttttggggaggagggcagggctaggggtgggacttgggagaaaacaggggtgggcttttggtttaattttttttttacttttttttccttgtcaaacctgaaatttgtggcttccttttaagttaaatggttgactgcaacacctttattttagattagttggagaaacatgcaataagattggcgtagtttcaatatctgtgtgtcttttcatgagtggctgttacttgtgaagaattgattttatgtaacctttatgtgagataattatttgtaaatatttgccataattttattggttcctaaaataaaagtaattttttaagttcagaaaaagaa

SEQ ID NO: 405412 - DNA, 8754 bp, Homo sapiens
agcactgctgctctcccggcttcccgctctactccggccgggccgggtccgccacgtctggcgcgctgagcaggcccggccgcgcagcgcctaccctttcctcgctccgggccggcagtgtggggcggcgcgctgggggcgcggcgtgtctggggacatcttgtgatgttggcgagaacaggacatgatctcacatggcgagaagctctttagttccttaatcatttcacggtgccttcggacgctttttttccacctaaaacgtttagtttcagctcagtgatcagctaccccagctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaagcagacttcctctggccaccgctaagtattttgttccctaagtcccccacagggtggtggaacagaagagaaaactaaggctcagcaaggtggagtcctcaagcagtgactggtgggggtggggctgggactcgggctcctgacccccaacccatggtgttccctgtcaccctggtctatccacatctcctattcctgaggagagttgacagtaagagcagtgagagatggttctgggccccatgccctagacaatcagtctgtaagaactgccaaggaagcctggtcacccaggccagggatggagcccagcgagctcacagcaggcacatgcacccccgcccccacccagaacctgcggggcaaagaagggaggtagttggggccagagtccacctccaggagccagggtgagctggctgcagcttccacctgtcaggtaaggtaggagaaggtatgttacctggcatctctctccctgcctccctccatttagcaggaagtggtggggtcaggggtcttcagcacagacttcttgagcctctgccccctgtcacccttcttttggaatgatgtgtacccacatctttggatcctgccctccttgtggttccaggctgttgggaggaggtcagcctcccctgaaccagctgcctgaggcatgcagcatccttcctcggcaaagcccacctggctcacagcggccccctctccccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccaaggtcatgtgctgtcccccacttccctttctttgccttcccactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagtatgaaaacttgtaaaattttctgtcggcctaaagaaaaatgtccatgggccaaacttgacccactgggcaccagcctgtgagccccaatgcctgtcaattgccccctttctcattcacctcctgtcctttgttgcagatttggaggagatgggagcccagagaggtgagagatgtgcttcagggtgtccagcaaggcaggggtagaaacgggcacgcccagagcctgccactctcccaggcctcatcttgggctcttgcaagccttgcgctttgaagatggagttgggtggaaggtcagaggcgctggggacgggattggggagctgctgggttttcaggggaggtcagtgctgcttgggcacctttcacatgtgcagggaagagactcagatgtggccacagggcactgaggggtgaaatccatttaccagaagtcacgctccagaacgactgcccagccttggcagccagtggctccagccaccccctcctcatgacattcagccagaattgagctccaagccaggaagcaaatcttaaaaaccaaccaagcaccctgacacagccctagaaacacgatgagtctgaaatacagcttcccaggaggggagtctaagatacagcttcccgggagggtggaaaccaactcctgccccacggcaggccaggcccaggcaggcatgggtggatcccacagggctctgagctagaccggctccacggtggccccactacgaggccagttctgcagtcttggccttgtcacccatcgagaggctgctctgatggttcccagccacacaccagctctcctggggaaactatttctttcgttcttttggcctcggagaggtccgaggcaagtacatttcttaaaaggtaataaaatgcattattggaaagttggacagtcaggccacgactcctagcccacggcgtgccccacctcccagcagccccttcagccccttgcccctgttgccccaaacctcagggttccctcttgcatattcatgggggaaccacagtgctgatgtgcacttccccactgtcagctcggctgcacctcgtgtggcgccaggtcccaagggcctctgcagaggccaggctgtgagccccttgcctgcctgctcccctgatgaggcaacagcttctctgaaatgagctgccggccaggagcaggcaggcaccagcctgtctttccttttctggtaattcctcagcactgaggctccgttcctgggcaccccaggattgaagggaacctcagaatcatgtcactgccattctagagtttcaatccaaggggtcccctttagctcatctccaagatgggtaaacgtagccaccattcagaaagcccagaaattcttgttcccacatcttagacccctgagcaacacaaggagaaaatgcagctgcttacctattaatatctactgagggacaatcagcaaagcctcaaaggagtcgtctcaggtagggtacttggcctgtggcaggagagacagaggcacaaacccacccacccatcagcttccggtggctgatcggggcccagggagggaagcaggtgaaacagcagggtgggggtgacttggcagtcatgcatctcctccccgactctgaggcctggcaggaggaggccacaccagcctcacctgccctgacccccgccccccaccctgtgaccctgtggctatggccgctggtcgcccttgtccccaaaatcaccatgcctgtggccacgtccctcatcttctccaaaagcatcattaagaacaagtgattttggatgatggatttttgatttacaaacggcgcatttcccttggagtggaacagaaaggaaaccatttaatggcgcccttcttttcaagcatgaatacattttaatgaaactattttattgtatttgaggaaatggagagttgaacattccaaccaatcaatagccaattaattgctataaagctaaaaagaaaataaataaatcctgagtctattttaaacactgcaaaaagttcagagcctcagaatctggccttcccctcccataaggtgcacgagcatgtaaacacacacacacacacacacacacacacacacacactcactcactcccctacacctcagacatacttgaaactcagaaacagcactgagtctccccatttctcagccccagctgctgggcctccaaggttgggctgaggatggagttttggctctgggtttgccctgactcctgctggaagacgctgccctggtttttcaccctctagtggccttggacattgagtatttgtagaaatgcagattacattgcaaatggaaacctttgccaggaagacacatgcattttgcttttaattctttgagacatttgattttgtcttagggactgacctttcagcatcaaagaaatacatatctactgtatccgccaaagtttgtgatgcctgcatagacgcttacttgtaaaaaaaaaaaaatacaaaaaaatacaaaaaaaccaacaacgaaaaaccacaattgaattgcctttgaaagtgggagatgatctgtctccaacggattgaaaaaaaaaaatgcttcttaaaaaatgtgtatgttttgtattctttttttctagtagaaaataactgacttgaaatattggtggtttttttcttagtgacgtgtgttgcttttgtgtgtaataatatttgaatgtaattacagcagtgccaatttgccaaagatgttggacatatttttcttttttggggaggagggcagggctaggggtgggacttgggagaaaacaggggtgggcttttggtttaattttttttttacttttttttccttgtcaaacctgaaatttgtggcttccttttaagttaaatggttgactgcaacacctttattttagattagttggagaaacatgcaataagattggcgtagtttcaatatctgtgtgtcttttcatgagtggctgttacttgtgaagaattgattttatgtaacctttatgtgagataattatttgtaaatatttgccataattttattggttcctaaaataaaagtaattttttaagttcagaaaaagaa

SEQ ID NO: 405413 - DNA, 7582 bp, Homo sapiens
ttctaactctaatctaaaaacccatgaggttgaaatcctcaagccccaagcgacacctgtgaaacggcccaagagaagcgtgccatgaggcagcaggaagggattccaggaggagggaacagagggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaagcagacttcctctggccaccgctaagtattttgttccctaagtcccccacagggtggtggaacagaagagaaaactaaggctcagcaaggtggagtcctcaagcagtgactggtgggggtggggctgggactcgggctcctgacccccaacccatggtgttccctgtcaccctggtctatccacatctcctattcctgaggagagttgacagtaagagcagtgagagatggttctgggccccatgccctagacaatcagtctgtaagaactgccaaggaagcctggtcacccaggccagggatggagcccagcgagctcacagcaggcacatgcacccccgcccccacccagaacctgcggggcaaagaagggaggtagttggggccagagtccacctccaggagccagggtgagctggctgcagcttccacctgtcaggtaaggtaggagaaggtatgttacctggcatctctctccctgcctccctccatttagcaggaagtggtggggtcaggggtcttcagcacagacttcttgagcctctgccccctgtcacccttcttttggaatgatgtgtacccacatctttggatcctgccctccttgtggttccaggctgttgggaggaggtcagcctcccctgaaccagctgcctgaggcatgcagcatccttcctcggcaaagcccacctggctcacagcggccccctctccccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccaaggtcatgtgctgtcccccacttccctttctttgccttcccactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagtatgaaaacttgtaaaattttctgtcggcctaaagaaaaatgtccatgggccaaacttgacccactgggcaccagcctgtgagccccaatgcctgtcaattgccccctttctcattcacctcctgtcctttgttgcagatttggaggagatgggagcccagagaggtgagagatgtgcttcagggtgtccagcaaggcaggggtagaaacgggcacgcccagagcctgccactctcccaggcctcatcttgggctcttgcaagccttgcgctttgaagatggagttgggtggaaggtcagaggcgctggggacgggattggggagctgctgggttttcaggggaggtcagtgctgcttgggcacctttcacatgtgcagggaagagactcagatgtggccacagggcactgaggggtgaaatccatttaccagaagtcacgctccagaacgactgcccagccttggcagccagtggctccagccaccccctcctcatgacattcagccagaattgagctccaagccaggaagcaaatcttaaaaaccaaccaagcaccctgacacagccctagaaacacgatgagtctgaaatacagcttcccaggaggggagtctaagatacagcttcccgggagggtggaaaccaactcctgccccacggcaggccaggcccaggcaggcatgggtggatcccacagggctctgagctagaccggctccacggtggccccactacgaggccagttctgcagtcttggccttgtcacccatcgagaggctgctctgatggttcccagccacacaccagctctcctggggaaactatttctttcgttcttttggcctcggagaggtccgaggcaagtacatttcttaaaaggtaataaaatgcattattggaaagttggacagtcaggccacgactcctagcccacggcgtgccccacctcccagcagccccttcagccccttgcccctgttgccccaaacctcagggttccctcttgcatattcatgggggaaccacagtgctgatgtgcacttccccactgtcagctcggctgcacctcgtgtggcgccaggtcccaagggcctctgcagaggccaggctgtgagccccttgcctgcctgctcccctgatgaggcaacagcttctctgaaatgagctgccggccaggagcaggcaggcaccagcctgtctttccttttctggtaattcctcagcactgaggctccgttcctgggcaccccaggattgaagggaacctcagaatcatgtcactgccattctagagtttcaatccaaggggtcccctttagctcatctccaagatgggtaaacgtagccaccattcagaaagcccagaaattcttgttcccacatcttagacccctgagcaacacaaggagaaaatgcagctgcttacctattaatatctactgagggacaatcagcaaagcctcaaaggagtcgtctcaggtagggtacttggcctgtggcaggagagacagaggcacaaacccacccacccatcagcttccggtggctgatcggggcccagggagggaagcaggtgaaacagcagggtgggggtgacttggcagtcatgcatctcctccccgactctgaggcctggcaggaggaggccacaccagcctcacctgccctgacccccgccccccaccctgtgaccctgtggctatggccgctggtcgcccttgtccccaaaatcaccatgcctgtggccacgtccctcatcttctccaaaagcatcattaagaacaagtgattttggatgatggatttttgatttacaaacggcgcatttcccttggagtggaacagaaaggaaaccatttaatggcgcccttcttttcaagcatgaatacattttaatgaaactattttattgtatttgaggaaatggagagttgaacattccaaccaatcaatagccaattaattgctataaagctaaaaagaaaataaataaatcctgagtctattttaaacactgcaaaaagttcagagcctcagaatctggccttcccctcccataaggtgcacgagcatgtaaacacacacacacacacacacacacacacacacacactcactcactcccctacacctcagacatacttgaaactcagaaacagcactgagtctccccatgccaattcttgcctgctgtcttcgacttgggtcagagaaggtgagcagacccggcagcagcctgtcccggggctcaggaagaggcaggcccatcccctggccccaagcacccagcacaacagagggtggcgggcagtgagggcctggcgttgcctgggccccacttctcagccccagctgctgggcctccaaggttgggctgaggatggagttttggctctgggtttgccctgactcctgctggaagacgctgccctggtttttcaccctctagtggccttggacattgagtatttgtagaaatgcagattacattgcaaatggaaacctttgccaggaagacacatgcattttgcttttaattctttgagacatttgattttgtcttagggactgacctttcagcatcaaagaaatacatatctactgtatccgccaaagtttgtgatgcctgcatagacgcttacttgtaaaaaaaaaaaaatacaaaaaaatacaaaaaaaccaacaacgaaaaaccacaattgaattgcctttgaaagtgggagatgatctgtctccaacggattgaaaaaaaaaaatgcttcttaaaaaatgtgtatgttttgtattctttttttctagtagaaaataactgacttgaaatattggtggtttttttcttagtgacgtgtgttgcttttgtgtgtaataatatttgaatgtaattacagcagtgccaatttgccaaagatgttggacatatttttcttttttggggaggagggcagggctaggggtgggacttgggagaaaacaggggtgggcttttggtttaattttttttttacttttttttccttgtcaaacctgaaatttgtggcttccttttaagttaaatggttgactgcaacacctttattttagattagttggagaaacatgcaataagattggcgtagtttcaatatctgtgtgtcttttcatgagtggctgttacttgtgaagaattgattttatgtaacctttatgtgagataattatttgtaaatatttgccataattttattggttcctaaaataaaagtaattttttaagttcagaaaaagaa

SEQ ID NO: 405414 - DNA, 2629 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacg

SEQ ID NO: 405415 - DNA, 470 bp, Homo sapiens
gggggtcagtgggctaggtgggttccttccccacctgaggcctcctcactgcctttttcgtggacctgagtcatgtgccatgctggccatcactgctgggggttgaggctatgcagagctgcgatggagggtgctccatgtgccagggaagtctggctctctagacccaccgggctcaggagaggaggaaactcgcccatgtggcctggacactgccctgtctcagacccagtggcgcgccactcgcaagcctggccacacccagctcccttcaccctctagtccaggggtctttccagcgttgtgggccacgtggtctctgacgcccacccagctgtgtggaagcagcacgaaacagggtggacgcaggtgatgtggttctggccaagtggaactctgtttaccaaaccagcggggagagcacaagccacgttttgtgactcctatttttcctgtgggtgggggaaacc

SEQ ID NO: 405416 - DNA, 5891 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405417 - DNA, 4414 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattaca

SEQ ID NO: 405418 - DNA, 5756 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405419 - DNA, 6004 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagtttataaggaataaaaagaatgataatattttcagctgtcaaaactatcaagactacaataacaagagcactgtcataattttaatggaagtaaaaagtatgcacttttcccaatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405420 - DNA, 5906 bp, Homo sapiens
gcatcccatgtagtcctgacgtttgatcagcctgtttgatttctttctgttgcatcgactaggtctgcctgcctgcctgctcctgccactggggaatgcgacagcaccaaaaggacaaaatgtacattacctgtgctgaatacacatcatcttattattggctggcaatgaatgccatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405421 - DNA, 4641 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405422 - DNA, 5979 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggagatgctgtagcacctgaggccaaggcccttttgccccgcttgtctgagcccagagcccggtccccagtcggtgcagcattcgcagggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405423 - DNA, 4503 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405424 - DNA, 4017 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacg

SEQ ID NO: 405425 - DNA, 4542 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatcccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405426 - DNA, 3922 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaaga

SEQ ID NO: 405427 - DNA, 4878 bp, Homo sapiens
  misc_feature (96)..(96): n is a, c, g, or t
gggctgcaggaattcggcacgagtgggcctgcagaggaggggcacagtaggacacagtgactgcccaggtgtccacacacctgtaggcctctgagncagcgtccagggtacaggtgcgggtggtggggatgaaggcctgaccagggagggagaagcaggtttggagaggaccctgtgcccaccccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405428 - DNA, 3074 bp, Homo sapiens
  misc_feature (2932)..(2932): n is a, c, g, or t
  misc_feature (2939)..(2939): n is a, c, g, or t
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgccccaaaaaaanaaaaaanaaaaaaaaaaaaaaaaacccgggctcttttccggggcggaaaaaggtaaaaaggcagggtaaggttttccgccccttttggaaaaggggaaaaacggggcccaaaaagggggaaaatcaaaaccgaagaacaaag

SEQ ID NO: 405429 - DNA, 824 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgtgagtggcggagggcactcggccaagccca

SEQ ID NO: 405430 - DNA, 736 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagattcagaaggacttgaaaatcaaagcccatgtcaatgtctccatggataccgggcccttttttgcggcgatgtctaacagcttctgcacatccggtatgacgct

SEQ ID NO: 405431 - DNA, 307 bp, Homo sapiens
aaccatccagccctcctccccagcttcatcacgtttcgctcctgtgcctacctggacaagaagcataccatctttggacggtaagggaagcggctgtgtgaagcctggggggtcagtgggctaggtgggttccttccccacctgaggcctcctcactgcctttttcgtggacctgagtcatgtgccatgctggccatcactgctgggggttgaggctatgcagagctgcgatggagggtgctccatgtgccagggaagtctggctctctagacccaccgggctcaggagaggaggaaactcgcccat

SEQ ID NO: 405432 - DNA, 1932 bp, Homo sapiens
ctggcttcaagtgagagcctcctgccttggcctccgaaagtgctggaattacaggcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaaga

SEQ ID NO: 405433 - DNA, 594 bp, Homo sapiens
  misc_feature (452)..(452): n is a, c, g, or t
  misc_feature (459)..(459): n is a, c, g, or t
ggaactcggctgcggctccatggtctgagttgtcagccgttgttttttcgtgctcgctagtcgccgccgccgctccgccatggggaagcgacagcaccaaaaggacaaaatgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgcaaaaaaanaaaaaanaaaaaaaaaaaaaaaaacccgggctcttttccggggcggaaaaaggtaaaaaggcagggtaaggttttccgccccttttggaaaaggggaaaaacggggcccaaaaagggggaaaatcaaaaccgaagaacaaag

SEQ ID NO: 405434 - DNA, 4059 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaaga

SEQ ID NO: 405435 - DNA, 5813 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccaggtgagggggcacgatgccaccacctaggagggtctgggctagtgcacttttccaccccaagcctagcatctgtcctgcccgaggtgctgccggttagccagcgcctgttgtgccacagattgcgcaggagcggaagacacagctcaaggtagccccggagaccaaagtgaagagcagccagccccaggcagggagccagggcccccagaccttccgccagggcgtgggcaagtacatcaacccagcagccacccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405436 - DNA, 6305 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccaggtaaggcatgcagtctttctgttccccgttgggggagtggtattaaggaactgtgtcttcaggatacagtgagctgtaaaaatagacaacaagaacacggaaactatggtagacgaatgggctgaggacacagttcatgaaagagaaatatactcaagatagaagaacctgcttcatcttagtggtgatttttgtaaaatgtaatttaaaatattccccgatgctgggagctaagtaaaaaataaataagtaaataaaatacaaaattacatgtacatttaaatgttttttctctatcaagtttataaggaataaaaagaatgataatattttcagctgtcaaaactatcaagactacaataacaagagcactgtcataattttaatggaagtaaaaagtatgcacttttcccaatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405437 - DNA, 6241 bp, Homo sapiens
ctcatcaccccctggcacctggggctgccttgcttgcctaaagccaagtacattacctgtgctgaatacactcacttttatggtggcaagaagccaggtaaggcatgcagtctttctgttccccgttgggggagtggtattaaggaactgtgtcttcaggatacagtgagctgtaaaaatagacaacaagaacacggaaactatggtagacgaatgggctgaggacacagttcatgaaagagaaatatactcaagatagaagaacctgcttcatcttagtggtgatttttgtaaaatgtaatttaaaatattccccgatgctgggagctaagtaaaaaataaataagtaaataaaatacaaaattacatgtacatttaaatgttttttctctatcaagtttataaggaataaaaagaatgataatattttcagctgtcaaaactatcaagactacaataacaagagcactgtcataattttaatggaagtaaaaagtatgcacttttcccaatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405438 - DNA, 5841 bp, Homo sapiens
ggaactcggctgcggctccatggtctgagttgtcagccgttgttttttcgtgctcgctagtcgccgccgccgctccgccatggggaagcgacagcaccaaaaggacaaaatatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405439 - DNA, 4964 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgtgagtgccgcggggctggcctccctgtttcccatggtgtttcctagggctgactgaggtctgagggtcagacccagaggggcaagcaagctatgggcactggtcccggccgtgggcttgtgctgtgtggcctctgcagccgagggactgcctctgaaggcctggccggggcctctgtgggtggaagagatcaaattcagggggatgtgggagcagcaggtgggaggggttgggcctacaccgggagggctgtatggagacacagacaagtcaggaggggctgagggagggtgtgggctcccagcggcttcttctcttcccaggaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405440 - DNA, 5393 bp, Homo sapiens
ggagcaggtcggacgccgtatcattttcttcttccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405441 - DNA, 3788 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctctcctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccggctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgaggccgattacattgctcgaagcttttgtaactcccgataggccaggtggggtttggcgagacgggactgagccgtgtgctcggcgtctggggaccctgtggccgggtcc

SEQ ID NO: 405442 - DNA, 3929 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggaaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405443 - DNA, 3628 bp, Homo sapiens
  misc_feature (96)..(96): n is a, c, g, or t
gggctgcaggaattcggcacgagtgggcctgcagaggaggggcacagtaggacacagtgactgcccaggtgtccacacacctgtaggcctctgagncagcgtccagggtacaggtgcgggtggtggggatgaaggcctgaccagggagggagaagcaggtttggagaggaccctgtgcccaccccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaaaaaatacaaaagtcataagactactagtaaaaaatgttcaatcaatgccgtcacaaaagacagtacaaaaaccaaagtgcccaaatagaaggagcagcgaacttgcccaaaacagaaaagctctaaatagaactttagtatatacaaaaaccactcggtagagttttagaagtttcttccatgtaagtgaagcatcttgagtcactcaggacttggctgtcctcgcacccgtggcaggctggggacggcacggacctccaactgtttcccctagtccccggggcatcggaggctgggttcccacatgggagaggaatgaagactcactcaaagggaagggtcagtttaagataagttttcagtgaactccttcttccacccgggaaggtgtctttcagcctcttcacagtctcaagacaattgactgaagccacaggcattgctaacttcatgggccagcttgtgggcggagcctcttcaggcttgagaccatggcagcaagagccctgcagcgtgcagtgacccctgcgctctgggtggctgcacgcgagctcaggaggacaggatgtgctgggccagcctaaaccctcgggggagactagcgcagggataaagcagcttgcagggccatagccggatgtggaggcttccaagacagtacaaagatttccttcctttcctaagtggaagatgtgctttaaaggaacttctgcctctgtcactcctgctgagtggatgcatctcagtgccatgcccaccagggcagcggcatttcccacctgccaaggcttccaggcttgggcaaagagatggcacccaaaggcatgctgtgtgtgggcagtgagctcgagtgggcacagcccagtgcctgcctggaccgcaggtctgggtttaggaagggctgaagtcgggggaggtgtgaagctgggcaggtggccacgttcttattgtcagccagctcgcactcttgcccctagactagccttgtctgaaggcagcttcagagccacttgccaggctgagaactatccgggctcagtgctctcctatctgctgcccctcggtccccctgcctgccctctgccctgagacaagttactaaatgttgaaaaccaaacttatctgggagtggtttttgacctccatcctctgcaaagtggcctaaacccttatggggtgcccactcctggtggagggcaggtggatgagtggattgtaatttataataaaatatatggcagaaacacaggccttaggagattgcacaggcccctctatcagttcaagtgacatgggacagcaccacgcagggacgggcaacgcgtctagcaggccaggcgtcttcatgcacaaaggctaaacttgttgctttaaccttttctgaacaaattttaaacattctggcaaatgtcaagttttgaagtttttcctgtgggttctggcctctttcatatgcaaaaata

SEQ ID NO: 405444 - DNA, 2767 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacg

SEQ ID NO: 405445 - DNA, 839 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgcccaagtaaatactaccgtatggccaccataattgaacccccataactccttacactattcctcatcgacccaagttaaaaaatattaaacagcaaaagtagcagctagctcacctcaaaccagaaggcccatgaacaaaaagaaagacaagaaac

SEQ ID NO: 405446 - DNA, 833 bp, Homo sapiens
ggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccaggtaaggcatgcagtctttctgttccccgttgggggagtggtattaaggaactgtgtcttcaggatacagtgagctgtaaaaatagacaacaagaacacggaaactatggtagacgaatgggctgaggacacagttcatgaaagagaaatatactcaagatagaagaacctgcttcatcttagtggtgatttttgtaaaatgtaatttaaaatattccccgatgctgggagctaagtaaaaaataaataagtaaataaaatacaaaattacatgtacatttaaatgttttttctctatcaagtttataaggaataaaaagaatgataatattttcagctgtcaaaactatcaagactacaataacaagagcactgtcataattttaatggaagtaaaaagtatgcacttttcccaatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagaggtactctttggggttcccaaacttgtcgattgtgctggcccccacacccacaaagtctgatctggcagttagccacgctgttagggcttacatcagg

SEQ ID NO: 405447 - DNA, 374 bp, Homo sapiens
tgaataatattaatccagcccctcaaggcagtcatctgtcttagagctattggaatcctggatcattgtgggaaatgaaagatacttcgatggaatcagcagccattgatccaatgccaactccaagactggaacgtcgcaatgatagttccaaggcggaaatttgacgtaattcttttcgacacagttttacaggtctggatgcccattttaattcttctgaaagcatgcctcctccttctggcttcaggactccatctccagcctcttgatctaaaaataatccccaaaccaaaaaattagatactatttcctcaaaattaggtattttaatcaaaacatcttaacataaatacattattatcacccaatat

SEQ ID NO: 405448 - DNA, 1243 bp, Homo sapiens
atcttcatccattagggtatctgagaataggcttggcatctgtggcatccttgtggacagggttcacatctgtgagaatggggctttgtctctgggatgtcaaagcggagggctggaaaatggcaaggggcatctggcacataggcgctccatgccattggtacccaggtggtcttaggagacagacacacaccagtacctaatgacaggatgagccaatcttggacctgcaaagggcacacagttgagctggggagatggataggtaaattgcagttaagagaaagtgtacttggaggagagtttctgaaaggaaggagcagggtctgtataatgtgcccttaagatctttctttcttgagtttccttgtcgcctgctcacgttcatggattagagtgagtccactcaagatcacctccaagaagccttcctgaccccccatctgatttagatgtctcagctctgagtttccatgacaccttgctcttaccattcctcccactgcactgtaattggcaaaagagagacccgaaacagcaccaggcatttcttactgggcccaaacaagggcaggagatgctgcctctgggggatttgtgtgtttattccaggcatgggaaggacaactgtggggcccacaggctgagtgaaccctcaagactgagcctcccatgactggtgccctgcagatcagcctgggccgtgactttccagcagggaaggatgtgtgatcagctgacggggtattatctttcattgtaaatgagtaaaatgacatcagtctcctgtgaggatggggcatgcgagtcacccagagtctcttaaatcccggactcactggacctgcagtgctaaagagcagagcacgggactgacacgtctctccagaacatctctccatcttaaactcacacacacacacacgcaaaacaacttttgctttttaaaatacaagtcatgccaagcacagtggctcacgcatataatcccaacactttgagaagccgagacgagaggatcacttcaggaatttaagaccagcctgggcaacaaagtgagaccctggctctacaaaaaactagccaggtatggtggcatgtgcctagggtctcagctacatgagaggctgaggcaggaagcagcactgtttgaagccaggaggtcgagctgcagtaagtcatgatcataccactgtactctagcctgggctggagtgagacccagagtgagactcggtctcag

SEQ ID NO: 405449 - DNA, 852 bp, Homo sapiens
atcttcatccattagggtatctgagaataggcttggcatctgtggcatccttgtggacagggttcacatctgtgagaatggggctttgtctctgggatgtcaaagcggagggctggaaaatggcaaggggcatctggcacataggcgctccatgccattggtacccaggtggtcttaggagacagacacacaccagtacctaatgacaggatgagccaatcttggacctgcaaagggcacacagttgagctggggagatggataggtaaattgcagttaagagaaagtgtacttggaggagagtttctgaaaggaaggagcagggtctgtataatgtgcccttaagatctttctttcttgagtttccttgtcgcctgctcacgttcatggattagagtgagtccactcaagatcacctccaagaagccttcctgaccccccatctgatttagatgtctcagctctgagtttccatgacaccttgctcttaccattcctcccactgcactgtaattggcaaaagagagacccgaaacagcaccaggcatttcttactgggcccaaacaagggcaggagatgctgcctctgggggatttgtgtgtttattccaggcatgggaaggacaactgtggggcccacaggctgagtgaaccctcaagactgagcctcccatgactggtgccctgcagatcagcctgggccgtgactttccagcagggaaggatgtgtgatcagctgaggcaggaagcagcactgtttgaagccaggaggtcgagctgcagtaagtcatgatcataccactgtactctagcctgggctggagtgagacccagagtgagactcggtctcag

SEQ ID NO: 405450 - DNA, 441 bp, Homo sapiens
ttatctataaattggaagctataatatttattccatcttgaacaacctagagaaatgaatgtttgcttcatttaattttttttgttttgagatggagcctcactctgtcacttaggctggagtgtagtagcatgatctcggctcactgcaacctctgcctcccagactcaagtgattttcctgccttggcctccttaaatgttggggttacaggcatgagccactgtgcccagcctgcaataatattttgataggaatctttttttctgaggggtaggtatcaataatgagcttaacatattcagcaaactgtagggtaaacagatatgctgtcatccaggctttgttgttccctttatagaacacaggcagagtagatttcgcataattttttttttaagagacaagatctctctccgttgcccagactggagtgcagtg

SEQ ID NO: 405451 - DNA, 895 bp, Homo sapiens
gaggtcaggagttggagaccatcctgggcaacttagcaagatccctatctcttaaaaaaaaaaaaaaaaggaagaagaagaaaaagcaaatgtaaacagcatgactacctctaaggctgagggagaacatccaagggagtaacagacttggaagagatctcaaccctgaggctaaaattcagacccccttggagaggacggggctgtagctagatggcagagaaattatatgtgtaaatgacagaggaattcactggagtgctgcagatagaggtggtggtgcagctgcaggtggggatggtgagctggaagccatctactggggtgaggtggaagcttattggagagtgagtgccaatggaactccataggtgacaccataagaacaaaatctacaacaaggagatctaggaagggcagctactgcctctctgctatgcctgcagtgtctctctagtgccctctgctgataagcctaacattgcaccagctggcaaatgagaaatgttcatgggatccagatccagatcagttaactccaaacaagaaaaagaaagattgctttggactaaggagcaataaattgataactggcacagtgttaccctcccttttttgtttttgtttttccattcacggctatactgtcaatatccattcatgctctatatgtatgattattggacattctatttttatacactccctggttttcttttcctttcattgttttggggctattttatagctctgaaagttgtagaaaactaataacaatgtaaaagatttttagttcatagaaatgaaaattatttgtgtctggtggaatatagtagattaaccaccctgtggttagaccattttccatcttttaaataaatgcattctagcattc

SEQ ID NO: 405452 - DNA, 1150 bp, Homo sapiens
cggccgcaacgcgcgcaggcggcggccgagtgcgcaggggccgcgcgcgcccgtcgctcgctagctggctggcaagctcagcacgccggctgcccgggacgccccgaggccacgccctccgcgcgaggccccgcccccacccccacctcccgagctgcggtaccgggttccgccccggcccgcgccctctagctggcgccacccaagcggcaagggacgtcgcggccctcccgggattggtgggaggatcgtgggggagcggcagctcaggacggaatacggcaatgaccgccccggtcgcgagggtgaccctgccccgggctgctgtgggggcgcaagaaccctttcactttacggcgagattaagctcagggtcaagttctgagcaaaaagtgtcaaggagcctttttgcaacctcctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaagtaagtattgtgctcaatgtcacaggctactaagtggcatgggaaaccaggtctcctgaatctagcctccgggtttctgctctccaccagcccaacctcagaaaattctaataggtgcagggggctttggcaaatagacccatgggaagaaggggaaacttatgtctagttaagtcgctgcccgattcctgctgtaaacataccaaggaaagcaacaggctgtcttcattgtgttgtcgcaccttccttcctgaaagggacgcagaaagattacatcaaatggcccagatgagatttcgccgacagtattttatggtttaaaatgggtgaaattatttggatgaagaaaagcgccttacttaaatttaatatgatgtgtaatgtaaattggtataatgtgtgaaaataagcccctccctgccttctctgccttttctctttttaattttgtttgtctctactgctctgctcaactcttttattgtccacataattgaaaacctaattgatggatatttgcatttccaaattaaacctttggctacttgacttaatt

SEQ ID NO: 405453 - DNA, 598 bp, Homo sapiens
taacagagactggttcaagggagattcggacacatctccacctccaaagccaagtgccttcccgggatgatctgcataacaatttgcgggtgctggtggtggagaagctccgggaagagaaaactagccggacggtatcgaaccgcccgcaggcccgtcgcagctccattaatgcaactaccattacactaaggctggagtacaatggcaccatctcagctcgccgcaacctccacctcctgggttcaagcgattctcctgcctcagcctcccgagtagctgggattacaggttccaagtctcttcttcggcctctcaaacatggtaccatccctaatgaagtcaacgggtccagcatgacaggatggaagtacaagtgtcagcacctatgtgagtcccaagaggggaaattagaaacaaaaaggaagaagaggacataggccaggcacggcggctcacgcctgtaatcccaacactttgggaggccaaggtgggcagatcacctgaggtcaggagttcaagaccagcctggtcaacatggcaaaagcccatctctactaaaaaatacaaaaaattagccaggcgtggtggtgggagc

SEQ ID NO: 405454 - DNA, 1106 bp, Homo sapiens
cggccgcaacgcgcgcaggcggcggccgagtgcgcaggggccgcgcgcgcccgtcgctcgctagctggctggcaagctcagcacgccggctgcccgggacgccccgaggccacgccctccgcgcgaggccccgcccccacccccacctcccgagctgcggtaccgggttccgccccggcccgcgccctctagctggcgccacccaagcggcaagggacgtcgcggccctcccgggattggtgggaggatcgtgggggagcggcagctcaggacggaatacggcaatgaccgccccggtcgcgagggtgaccctgccccgggctgctgtgggggcgcaagaaccctttcactttacggcgagattaagctcagggtcaagttctgagcaaaaagtgtcaaggagcctttttgcaacctcctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaatatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagagttccaagtctcttcttcggcctctcaaacatggtaccatccctaatgaagtcaacgggtccagcatgacaggatggaagtacaagtgtcagcacctatggatcatacccagattgccctcagttccaataatcaccaagtgcacatctataagaagaacggagccgggcgctgtggctcacgcctataattccagcactttgagaggcctcggcaggtggatcacgagatcaggagttcaagaccagcctggccaagatggtgaaaccccatctctactaaaaatacaaaaattagccaggcatggtgtggcgggcgcctgtaatcccagctacccgggaggctgaggcaggagaattgctgg

SEQ ID NO: 405455 - DNA, 379 bp, Homo sapiens
tatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagagtaagtcattccatttatatcaatattcttaaggcaatgtgctaggtgacgagccatattgatgacaaagacagagctcctattttcatgacattccagtgtggtggcagaaacaagcaagtaaataattccagtacacacttctgttgatttatttcgtgaatggtgactggctatttaaaaagactaaatcaaattaattttctgataatgaataaaaaaggatagcca

SEQ ID NO: 405456 - DNA, 1166 bp, Homo sapiens
cggccgcaacgcgcgcaggcggcggccgagtgcgcaggggccgcgcgcgcccgtcgctcgctagctggctggcaagctcagcacgccggctgcccgggacgccccgaggccacgccctccgcgcgaggccccgcccccacccccacctcccgagctgcggtaccgggttccgccccggcccgcgccctctagctggcgccacccaagcggcaagggacgtcgcggccctcccgggattggtgggaggatcgtgggggagcggcagctcaggacggaatacggcaatgaccgccccggtcgcgagggtgaccctgccccgggctgctgtgggggcgcaagaaccctttcactttacggcgagattaagctcagggtcaagttctgagcaaaaagtgtcaaggagcctttttgcaacctcctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaatatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagatttcactcttgttccccaggctggagtacaatggcaccatctcagctcgccgcaacctccacctcctgggttcaagcgattctcctgcctcagcctcccgagtagctgggattacaggttccaagtctcttcttcggcctctcaaacatggtaccatccctaatgaagtcaacgggtccagcatgacaggatggaagtacaagtgtcagcacctatgtgagtcccaagaggggaaattagaaacaaaaaggaagaagaggacataggccaggcacggcggctcacgcctgtaatcccaacactttgggaggccaaggtgggcagatcacctgaggtcaggagttcaagaccagcctggtcaacatggcaaaagcccatctctactaaaaaatacaaaaaattagccaggcgtggtggtgggagc

SEQ ID NO: 405457 - DNA, 1365 bp, Homo sapiens
cggccgcaacgcgcgcaggcggcggccgagtgcgcaggggccgcgcgcgcccgtcgctcgctagctggctggcaagctcagcacgccggctgcccgggacgccccgaggccacgccctccgcgcgaggccccgcccccacccccacctcccgagctgcggtaccgggttccgccccggcccgcgccctctagctggcgccacccaagcggcaagggacgtcgcggccctcccgggattggtgggaggatcgtgggggagcggcagctcaggacggaatacggcaatgaccgccccggtcgcgagggtgaccctgccccgggctgctgtgggggcgcaagaaccctttcactttacggcgagattaagctcagggtcaagttctgagcaaaaagtgtcaaggagcctttttgcaacctcctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaatatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagagttccaagtctcttcttcggcctctcaaacatggtaccatccctaatgaagtcaacgggtccagcatgacaggatggaagtacaagtgtcagcacctatgtgacaccataagaacaaaatctacaacaaggagatctaggaagggcagctactgcctctctgctatgcctgcagtgtctctctagtgccctctgctgataagcctaacattgcaccagctggcaaatgagaaatgttcatgggatccagatccagatcagttaactccaaacaagaaaaagaaagattgctttggactaaggagcaataaattgataactggcacagtgttaccctcccttttttgtttttgtttttccattcacggctatactgtcaatatccattcatgctctatatgtatgattattggacattctatttttatacactccctggttttcttttcctttcattgttttggggctattttatagctctgaaagttgtagaaaactaataacaatgtaaaagatttttagttcatagaaatgaaaattatttgtgtctggtggaatatagtagattaaccaccctgtggttagaccattttccatcttttaaataaatgcattctagcattc

SEQ ID NO: 405458 - DNA, 318 bp, Homo sapiens
ctagctcacccttggcatttaataattttataaaatttcagctgatttttaaattttctttcatggaagctgttgagtagccccttatttccctaattctttgactcagataagactattcttctgttttatctcttattatagaggtatgttcctctttggaatttaagtaatttggttggactgcaacctcaggtatctaatgtgctcaaaaaagttataattttatgggtttttttttttttgtctttatctcattgttagaatgggaacaatgttcttttcagctttctacatcttagccagaaacagaaatct

SEQ ID NO: 405459 - DNA, 744 bp, Homo sapiens
tcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggagtacagtccttcagagattccagctgaaagcctgtggtatttaacaaggcccatcatcactggtggaatctgaacttcaagtctgatttccttggcacataattttctactaaaagctctgcacctggctgctgtgaatttccaaatctatcccaagtccctgtgtgtcacagtacaatccattaggatttggaagctgtattaatccattttcatgctgctgataaagacagacccgagactgagcaatttacaaaacaaagaggtttaatggacttacagttccatgtggctggggaggcctca

SEQ ID NO: 405460 - DNA, 753 bp, Homo sapiens
agccacctggtgtccgtggggtatctagttgcgaagccagatgtgatcttcaggctctggggggtgaatggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggaagacagagtttcaccatgttgcccagactggtctcaaacacctggattcaagcaatccactcgccttggcctcccaaagtgctgggattacaggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgac

SEQ ID NO: 405461 - DNA, 1324 bp, Homo sapiens
tcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggaatgtatccatttttgcctcatgtattttgaagtgctgttattagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgt

SEQ ID NO: 405462 - DNA, 1323 bp, Homo sapiens
gagaccctataaatgcagtgtctctctccatatgaattttcttatgtttaatcagagttgacttctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcctcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaagctactcaaatcattcaataaatgataaaattattt

SEQ ID NO: 405463 - DNA, 2327 bp, Homo sapiens
tcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggaaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcctcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaagctactcaaatcattcaataaatgataaaattattt

SEQ ID NO: 405464 - DNA, 1974 bp, Homo sapiens
tacttcacaggggggggggaccccggtacggacctgtgcagatgtatccatttttgcctcatgtattttgaagtgctgttattagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcctcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaagctactcaaatcattcaataaatgataaaattattt

SEQ ID NO: 405465 - DNA, 1112 bp, Homo sapiens
ggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405466 - DNA, 502 bp, Homo sapiens
tgcttgacttcaattctggaggagatgttgtttccgccgggcggccccaaaaacttgcctgtatggatgggtgggggttcaaaaaagggtgcctttgacggggatagtttgccctggaaatcccacgtttaacaaagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405467 - DNA, 1272 bp, Homo sapiens
ggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405468 - DNA, 1252 bp, Homo sapiens
ggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405469 - DNA, 1676 bp, Homo sapiens
cttttttttaaatgggcattttgtaaaatgaaaaattaagttatataaaagtaaaatgccacgagttcctcacttatcttgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattgaaatgcctggtgttgctgtgttggcgagcagcatcttgcagttacatagaaatgtaaagttcatctctgaatagcatttcaaaagggttgttagaaaatagctccctgattttaaagcggtttagtcagggtgagtgggtgtgttaaccagcagtgcataactaagcctgccctgcctgtctctaattagcaccaagctagttactttcaaggtctgtttctagaataagagtgacttccttt

SEQ ID NO: 405470 - DNA, 1589 bp, Homo sapiens
cttttttttaaatgggcattttgtaaaatgaaaaattaagttatataaaagtaaaatgccacgagttcctcacttatcttgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttgggtgaggcagtgcagtgctttttgggaaatgcatcagatcttttctgttcttgaaacgccaaatctaacttggtctttttttggatgaattaccgccagtattatgaaggttactgtgaaggaacttgagaccactgaactttttgagttcttgcgactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405471 - DNA, 1575 bp, Homo sapiens
cttttttttaaatgggcattttgtaaaatgaaaaattaagttatataaaagtaaaatgccacgagttcctcacttatcttgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttccccataacttttactgaaacaacaacaaaaaaaaaaaaattggggcggccaaaagttaaactgtggggggccaggtagaatgtaacgtccaaggcacaggggtacaaaagcggcgggtaaggtgtggaagcaacaaaccggggggaaggaggagtacgactccgtt

SEQ ID NO: 405472 - DNA, 1508 bp, Homo sapiens
cttttttttaaatgggcattttgtaaaatgaaaaattaagttatataaaagtaaaatgccacgagttcctcacttatcttgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttgggtgaggcagtgcagtgctttttgggaaatgcatcagatcttttctgttcttgaaacgccaaatctaacttggtctttttttggatgaattaccgccagtattatgaaggttactgtgaaggaacttgagaccactgaactttttgagttcttgcgactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405473 - DNA, 1171 bp, Homo sapiens
ggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405474 - DNA, 1348 bp, Homo sapiens
ggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactgaagctgggaagtccaggattcaggggctacatctggtgaaggccttcttgctgatgactctctgcagggtcctgaggtggcacaggctatcacatggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405475 - DNA, 739 bp, Homo sapiens
ggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactgagccaggcctaagttcagagccagggtcgggtggagccctaagttcagagccagggggt

SEQ ID NO: 405476 - DNA, 1434 bp, Homo sapiens
cttttttttaaatgggcattttgtaaaatgaaaaattaagttatataaaagtaaaatgccacgagttcctcacttatcttgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405477 - DNA, 1336 bp, Homo sapiens
caacagggaccgaccaaatcgtcatgcagctgtttggatgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405478 - DNA, 1234 bp, Homo sapiens
cactattacagtctgcttcttatttcccgtgaagagaatgtttcgggtgtctattcccaaggaggacaaaagcttcttgttgctatgggagccgccccactgttatctcaagccatgtgcatcatggatatcctgtagctcagtccacacatctagcaattccccacttcgtgggcagcggctatcacattaacggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405479 - DNA, 1191 bp, Homo sapiens
ggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405480 - DNA, 1088 bp, Homo sapiens
ggcggcggcagcggcagcggcagcggcgctgagttttgtctcccgggccgtctgggcgcgcgcgggtgtcccagactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405481 - DNA, 1134 bp, Homo sapiens
ggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattga

SEQ ID NO: 405482 - DNA, 354 bp, Homo sapiens
caccgagggccttgttctactaggaaataagccccagtttatgcttcgttgtttctgtgtgtgtaaataagatgaaggaaagcacagaaagaaaaggagaggcgaaaccctccattctcacaatcaaatctaaattgtataatgtcctccaagttttagagtgacagcagtcattgccaaaagtgtggtgtggtcagatcagacaagcgttggttgttagaacactttaaagaacacttagaaaccgacaggtctcacgcacgggaccctccctaaaagctggcacacgtagggtttcttttgtgcagttaagaaaataggctctttccctaagtctcagagcagcagctcctg

SEQ ID NO: 405483 - DNA, 6548 bp, Homo sapiens
gtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatcctagcactttgagaccactaaggcgggtggatcacctgaggccaggagttcgagaccagcctggccaacatggcaaaaccctgtctactaaaaatacaaaaattagccgggcatggtggcgtgtgcctgtggtcccagctgctggggggctgaggcaggaggatcagttgaacgtgggaggcagaggttgcagtgagctgagatctcaccactgcactccagcctgggcagcagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttaaagagacagagtctcactctgtcacccaggctggagtgcagtggcacgatctgggctcactgcaacctccgcctcctgggttcgggcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactaccattcaaataatcattccctattttacaatgcatcagttctgtcaagcttcattcaaagtgtttttcattgtctctagtgttcagaagtttgggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaagtcgact

SEQ ID NO: 405484 - DNA, 526 bp, Homo sapiens
aattctaatagtttttattttttgagacattctctcttagccatgaattatttaatagtatgcttaattttctggtgtttggcatatttgttactgatttctaatttgttccatgtttgatctgactgtttaaatgtgttaacatttttttatgacccaggatagggtctatcttgtttcgtatagctgcttgaaaagaatgggtgttctgctgttactgggtggagtttctataaatgtctctatgatcctgctcattgttattcaagtcagctatgtccttgctgattttctgtccagcatttctgtcagttgctgagaggggtgttgaaccactgcacccggccacaagatgtaatttttactttatctctcacacgtattttacaaaacgtcatgagaaacattgtctcttgaccttttttttttttttttttttaaagagacagagtctcactctgtcacccagtgcactccagcctgggcaacagagcgagactccatctcaaaaaaaaaaaagtcgact

SEQ ID NO: 405485 - DNA, 3136 bp, Homo sapiens
ctgtctgtaatatcgcattttttagtgattgttctactattacagtgtaaatatatatcttatgatagttttataagttatcagcgatttagcactgtacttccattaggttcctttagcttacctactaatgttactatcttaagttatagtaattcctcttctaaaattgagcgctattttgcaagatgtaatttgtcttttccttttttttgagaccaagtctcactctgtcacccacgcagaggttgcagtgagctgagatctcaccactgcactccagcctgggcagcagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttaaagagacagagtctcactctgtcacccaggctggagtgcagtggcacgatctgggctcactgcaacctccgcctcctgggttcgggcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactaccattcaaataatcattccctattttacaatgcatcagttctgtcaagcttcattcaaagtgtttttcattgtctctagtgttcagaagtttgggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaagtcgact

SEQ ID NO: 405486 - DNA, 2893 bp, Homo sapiens
  misc_feature (42)..(42): n is a, c, g, or t
  misc_feature (47)..(47): n is a, c, g, or t
gcacgagaaaatggttcgggccagtgagaagatagctgtctnctgtntgttgtttttcactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttaaagagacagagtctcactctgtcacccaggctggagtgcagtggcacgatctgggctcactgcaacctccgcctcctgggttcgggcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactaccattcaaataatcattccctattttacaatgcatcagttctgtcaagcttcattcaaagtgtttttcattgtctctagtgttcagaagtttgggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaagtcgact

SEQ ID NO: 405487 - DNA, 2761 bp, Homo sapiens
ggaatagtgagaaaggccatccttacctggttcctgatagtaggggggacaatgttcagttttttgtttttttgttttttgtttgagacagggtctcgctctgtcacccaggctggagtgcagtggcacgatcttgtctcaccatagccttaagttcctgggctcaagtgatccccccacctcagccctcaccaccccccagtagctggtactacaagcatgcaccaccagtcccagctaatttttgtattttttggtagagacagggtttcaccatggtgcccaggctggtcttgaactcctgggctcaagcaacctgcttgcctgggtctcccaaagtgctgggattacaggcgtgagccacagtgcacagcatgttcagtttttcatcatgaagtataatgtaagttttataaaacatatgtcctctataagggtaaaaaatttcctctgttcccagttttctgagactctgtgttgctatgaataagtgtggaattttgttcagtactttttctccaccagttgatgtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccactgcacccggccacaagatgtaatttttactttatctctcacacgtattttacaaaacgtcatgagaaacattgtctcttgaccttttttttttttttttttttaaagagacagagtctcactctgtcacccaggctggagtgcagtggcacgatctgggctcactgcaacctccgcctcctgggttcgggcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactaccattcaaataatcattccctattttacaatgcatcagttctgtcaagcttcattcaaagtgtttttcattgtctctagtgttcagaagtttgggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaagtcgact

SEQ ID NO: 405488 - DNA, 739 bp, Homo sapiens
gctttggttgtatttggctctttctaacttttcaaggtggggttttagattattgatttgagatttttttgcttttttaatgtaagcattacattgtataaatttacctcatatcactattggtttgatcccacaagttttaatgttttcattacattttaattctaatagtttttattttttgagacattctctcttagccatgaattatttaatagtatgcttaattttctggtgtttggcatatttgttactgatttctaatttgttccatgtttgatctgactgtttaaatgtgttaacatttttttatgacccaggatagggtctatcttgtttcgtatagctgcttgaaaagaatgggtgttctgctgttactgggtggagtttctataaatgtctctatgatcctgctcattgttattcaagtcagctatgtccttgctgattttctgtccagcatttctgtcagttgctgagaggggtgttgaagtcctgaacataggccgggtgcagtggctcacgcctgtaatcctagcactttgagaccactaaggcgggtggatcacctgaggccaggagttcgagaccagcctggccaacatggcaaaaccctgtctactaaaaatacaaaaattagccgggcatggtggcgtgtgcctgtggtcccagctgctggggggctgaggcaggaggatcagttgaacgtgggaggcagaggttgcagtgagctgagatc

SEQ ID NO: 405489 - DNA, 731 bp, Homo sapiens
gtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggcacctttacagacacacccaggatcaatacgttgcatccttcaatccaatcaagttgacacattaataaaaatcccagagcacactgagcattgaatactttctctttaaatttaacgactgttactggtgggaagtattattgtattgatccagaaataaaggctcagagaaatgaaatgatgtttttgaggtaacagctgtcaagt

SEQ ID NO: 405490 - DNA, 424 bp, Homo sapiens
catggtaaagttggtcttctcttaaattgaattccctcaaaaaaggtacttttaaataaatcacattttcttctgaaccccaaaagcatatggaactatcactattaaaataattagtaaacctgggcgttgggaagtacgagagagctcacgtgttggtcactaaagaccagaggccagcattagcttctcagctccaggccctgagtaggagcggggaagatctctgtactcctgagagatcactcgattcccagccctgagttcccctcccagagcactgatgtgggccgggcaggactgcatgcatttgcatctattttagcttcttactgtcaagcgcaaaggaaaaacacctggattctccaatcagaaaggtatttatctcataataagccaatgggaatcagcataatgcaagttg

SEQ ID NO: 405491 - DNA, 2041 bp, Homo sapiens
gaattcggcacgaggttagcaataaggctggagaaggaaaagccggcgcgcccgcggcccgcgcgatttcccgccgagcccgcgtccccggcggcgggcgggctccgggggcgcccgggccgcggcggcgcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtaca

SEQ ID NO: 405492 - DNA, 2901 bp, Homo sapiens
gaattcggcacgaggttagcaataaggctggagaaggaaaagccggcgcgcccgcggcccgcgcgatttcccgccgagcccgcgtccccggcggcgggcgggctccgggggcgcccgggccgcggcggcgcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctatgattgacattttctgctcggcagagttcagggactggaattgcaagagtattttcatgcgtgttgaagatgaactggaaatccctccggcacctcaatctcaacatttccaaaactgaactcatcacccctcttcccccaccaccaaaactgctcctcctcctgtattcctgacctccgccatccaccccgttgctcaagccggaaactcggcagcccttccaaactcttccctctctcactccccacatcccatcgtctcggccttcacaatctgtcagttctaacctcctaagcaactaggccttcagtaaatgtgattcacctcttctttccctccttttcccaaagcatccctcttagtctaggtccttgttgtttcttgcctgaactcctgccatagtcttaactggtctccttgcttcctgtcttatcctccaccgtctttcttttatactgacacaagaatggtctttctgaattgcacatgtgagcatgtcacttccctgcttaaatttctccagtggattcccagggacttcaggatcaagtcctagttgttcagcatggcatccaagactctttatgatctggcccttgcttacctctcagccttagctctcccaactcttgcacagtcactgctcttcagccatagtggatcactcaccattcccagatgtaccaggctctcgcacacctctgcacctttgcacgtgctgtttgctgtgcgtggaatgcccttcactgtcaccaccctgctcatccactctactaatgcctcttcattcttttatactcagctttctttaaagttcttctaagctgagttaggtgtctgtcctttatgatcccgcagtattccatgaatacgtatattctcacatttattgtactgtattataattgttgaaaacttgtctgtcccatttagaatgtgagctccttgagagcagaacggtgtcttcattatctctgtatccccaaggctttgcacagtgccttgctcatagtaggttttcaataaatgattattaaataaataataa

SEQ ID NO: 405493 - DNA, 2776 bp, Homo sapiens
gacctgccctgcgctagctacctagccctgcctcactgcatcccagaagaggcacgtcggccttcatttgcctagtggattttcaaaagcagctcttcggtttttggtgctgttaagagaccttgcatttcaatcacacgggagaaaactgaagctcgtaacaggagaatctggcagctggacacagcttggactgcattgtctggcttcatgacccctgctgtggagccggctcatcttttcactttcacatggacactctcctcgcttttctttctttttttttccccttttctttcttctaatttttaaaaagcagcctctggagccagccatgtttggcactgaatcttcagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaaaaaaaaaaaaaaaaaaaaaaaaaaaaaaaaaaaaaaaaaaaaaaaaaaaaaaaaaaaaaaaaaaaaaaaaagggggggcgcccccacaaacataaaacccaagagaggagcacaccaaaagaaaagacaacacagtaacaacaacaacagggagcgacaaaaagagaaacaataaaaaacgagagaaaaagcgagcgcacaaaagaaaaaacaaagaggaggaggaaaacaagcacgcacgaacgacacaaaaaggagagaagaacaagcacaaagacaagggaagacgcaacaaacaacgagaggacacacaaaagaaacgaaaagagacaagacacacaaaggaaagagaaaaaaccacacaacaaaacaaacgaagcatacaaaaggccgcacacacacgacgaagaaacgacaaagaagcgaacaaaagacagaaaaagcacaacagcaagacaacataacacaaacaacaatgcaaaggaagcaacagacaaaaaaagagacgacacaaaaaacgaaagcacacgaaaaaagaaggaacaaaacaagcaaaaaggacgaaaaagaagagaagagagaagcaagagaaaaagaacaaaaacgaacagaagaacagacagaaaaaaagaaaagcagaaaaccaacagacaacaaaaa

SEQ ID NO: 405494 - DNA, 1597 bp, Homo sapiens
cctcagactgcacgttttccctgagctctctactgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaaaaaaaaaaaaaaaaaaaaaaaaaaaaaaaaaaaaaaaaaaaaaaaaaaaaaaaaaaaaaaaaaaaaaaaaagggggggcgcccccacaaacataaaacccaagagaggagcacaccaaaagaaaagacaacacagtaacaacaacaacagggagcgacaaaaagagaaacaataaaaaacgagagaaaaagcgagcgcacaaaagaaaaaacaaagaggaggaggaaaacaagcacgcacgaacgacacaaaaaggagagaagaacaagcacaaagacaagggaagacgcaacaaacaacgagaggacacacaaaagaaacgaaaagagacaagacacacaaaggaaagagaaaaaaccacacaacaaaacaaacgaagcatacaaaaggccgcacacacacgacgaagaaacgacaaagaagcgaacaaaagacagaaaaagcacaacagcaagacaacataacacaaacaacaatgcaaaggaagcaacagacaaaaaaagagacgacacaaaaaacgaaagcacacgaaaaaagaaggaacaaaacaagcaaaaaggacgaaaaagaagagaagagagaagcaagagaaaaagaacaaaaacgaacagaagaacagacagaaaaaaagaaaagcagaaaaccaacagacaacaaaaa

SEQ ID NO: 405495 - DNA, 1715 bp, Homo sapiens
agaggctgcctagaaacatgcattaacaggtgcttcttgggccaccctagcctgaagaaggacaaccagagagtataacagtggcacctcaatgccttggccttgaggaccctcagtgtcccttcaggcctccagatttgaggggaggctctagcatgttctggctgcagctattgtcttcagggattctgcagcttgtagctgcttggggtacttctaccaattggagctgggctgttggagtcatctccactgcctaccaccaggacaagcagagaagttacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctatgattgacattttctgctcggcagagttcagggactggaattgcaagagtattttcatgcgtgttgaagatgaactggaaatccctccggcacctcaatctcaacatttccaaaactgaactcatcacccctcttcccccaccaccaaaactgctcctcctcctgtattcctgacctccgccatccaccccgttgctcaagccggaaactcggcagcccttccaaactcttccctctctcactccccacatcccatcgtctcggccttcacaatctgtcagttctaacctcctaagcaactaggccttcagtaaatgtgattcacctcttctttccctccttttcccaaagcatccctcttagtctaggtccttgttgtttcttgcctgaactcctgccatagtcttaactggtctccttgcttcctgtcttatcctccaccgtctttcttttatactgacacaagaatggtctttctgaattgcacatgtgagcatgtcacttccctgcttaaatttctccagtggattcccagggacttcaggatcaagtcctagttgttcagcatggcatccaagactctttatgatctggcccttgcttacctctcagccttagctctcccaactcttgcacagtcactgctcttcagccatagtggatcactcaccattcccagatgtaccaggctctcgcacacctctgcacctttgcacgtgctgtttgctgtgcgtggaatgcccttcactgtcaccaccctgctcatccactctactaatgcctcttcattcttttatactcagctttctttaaagttcttctaagctgagttaggtgtctgtcctttatgatcccgcagtattccatgaatacgtatattctcacatttattgtactgtattataattgttgaaaacttgtctgtcccatttagaatgtgagctccttgagagcagaacggtgtcttcattatctctgtatccccaaggctttgcacagtgccttgctcatagtaggttttcaataaatgattattaaataaataataa

SEQ ID NO: 405496 - DNA, 1967 bp, Homo sapiens
gaattcggcacgaggttagcaataaggctggagaaggaaaagccggcgcgcccgcggcccgcgcgatttcccgccgagcccgcgtccccggcggcgggcgggctccgggggcgcccgggccgcggcggcgcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaatttcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctatgattgacattttctgctcggcagagttcagggactggaattgcaagagtattttcatgcgtgttgaagatgaactggaaatccctccggcacctcaatctcaacatatacctatgagatgtaataagaattcgtgctcggacacccgattctgttgcttgttcttgttcccggacttcctccaaccatccccttttcgggctt

SEQ ID NO: 405497 - DNA, 1787 bp, Homo sapiens
gaattcggcacgaggttagcaataaggctggagaaggaaaagccggcgcgcccgcggcccgcgcgatttcccgccgagcccgcgtccccggcggcgggcgggctccgggggcgcccgggccgcggcggcgcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaatttcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctgtgagtgtttgcctagagggaggcc

SEQ ID NO: 405498 - DNA, 1166 bp, Homo sapiens
tttgaccatcagctgatgtttcctgtaaacataaagatgaaatggttgccttttgagactttcgtaatgcagagacttaagctgcaagcgtgggtggagaggtttgttttatagtcttgaacaaggtttctgctgacttctgtgtctgtctggtttctttgcagttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaaaaaaaaaaaaaaaaaaaaaaaaaaaaaaaaaaaaaaaaaaaaaaaaaaaaaaaaaaaaaaaaaaaaaaaaagggggggcgcccccacaaacataaaacccaagagaggagcacaccaaaagaaaagacaacacagtaacaacaacaacagggagcgacaaaaagagaaacaataaaaaacgagagaaaaagcgagcgcacaaaagaaaaaacaaagaggaggaggaaaacaagcacgcacgaacgacacaaaaaggagagaagaacaagcacaaagacaagggaagacgcaacaaacaacgagaggacacacaaaagaaacgaaaagagacaagacacacaaaggaaagagaaaaaaccacacaacaaaacaaacgaagcatacaaaaggccgcacacacacgacgaagaaacgacaaagaagcgaacaaaagacagaaaaagcacaacagcaagacaacataacacaaacaacaatgcaaaggaagcaacagacaaaaaaagagacgacacaaaaaacgaaagcacacgaaaaaagaaggaacaaaacaagcaaaaaggacgaaaaagaagagaagagagaagcaagagaaaaagaacaaaaacgaacagaagaacagacagaaaaaaagaaaagcagaaaaccaacagacaacaaaaa

SEQ ID NO: 405499 - DNA, 355 bp, Homo sapiens
cattgactcccccagcgaaatgtttccagattctattaagttttcgctctttccaaagcttttcctcttcagcctataaaaagcaagcagctatttgcttcattcccaggggtacttctaccaattggagctgggctgttggagtcatctccactgcctaccaccaggacaagcagagaagtgtgagtggaagagagagaggtggcagggaaatctcccttagtgtgagctgtgtggtcaggggtcccaggtgcccacagtcatagaggaggtaggggcccacttgaaaatcaccagatgcttttttcagaccaggcctgagtggttttttgtctcccagcctgggttgcttata

SEQ ID NO: 405500 - DNA, 2845 bp, Homo sapiens
gacctgccctgcgctagctacctagccctgcctcactgcatcccagaagaggcacgtcggccttcatttgcctagtggattttcaaaagcagctcttcggtttttggtgctgttaagagaccttgcatttcaatcacacgggagaaaactgaagctcgtaacaggagaatctggcagctggacacagcttggactgcattgtctggcttcatgacccctgctgtggagccggctcatcttttcactttcacatggacactctcctcgcttttctttctttttttttccccttttctttcttctaatttttaaaaagcagcctctggagccagccatgtttggcactgaatcttcagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgaaattaggtccagagttgaagttcccctaattgcttcctctaccatctgggagataaaattgttaccaaagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaaaaaaaaaaaaaaaaaaaaaaaaaaaaaaaaaaaaaaaaaaaaaaaaaaaaaaaaaaaaaaaaaaaaaaaaagggggggcgcccccacaaacataaaacccaagagaggagcacaccaaaagaaaagacaacacagtaacaacaacaacagggagcgacaaaaagagaaacaataaaaaacgagagaaaaagcgagcgcacaaaagaaaaaacaaagaggaggaggaaaacaagcacgcacgaacgacacaaaaaggagagaagaacaagcacaaagacaagggaagacgcaacaaacaacgagaggacacacaaaagaaacgaaaagagacaagacacacaaaggaaagagaaaaaaccacacaacaaaacaaacgaagcatacaaaaggccgcacacacacgacgaagaaacgacaaagaagcgaacaaaagacagaaaaagcacaacagcaagacaacataacacaaacaacaatgcaaaggaagcaacagacaaaaaaagagacgacacaaaaaacgaaagcacacgaaaaaagaaggaacaaaacaagcaaaaaggacgaaaaagaagagaagagagaagcaagagaaaaagaacaaaaacgaacagaagaacagacagaaaaaaagaaaagcagaaaaccaacagacaacaaaaa

SEQ ID NO: 405501 - DNA, 2764 bp, Homo sapiens
gaattcggcacgaggttagcaataaggctggagaaggaaaagccggcgcgcccgcggcccgcgcgatttcccgccgagcccgcgtccccggcggcgggcgggctccgggggcgcccgggccgcggcggcgcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaatttcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaaaaaaaaaaaaaaaaaaaaaaaaaaaaaaaaaaaaaaaaaaaaaaaaaaaaaaaaaaaaaaaaaaaaaaaaagggggggcgcccccacaaacataaaacccaagagaggagcacaccaaaagaaaagacaacacagtaacaacaacaacagggagcgacaaaaagagaaacaataaaaaacgagagaaaaagcgagcgcacaaaagaaaaaacaaagaggaggaggaaaacaagcacgcacgaacgacacaaaaaggagagaagaacaagcacaaagacaagggaagacgcaacaaacaacgagaggacacacaaaagaaacgaaaagagacaagacacacaaaggaaagagaaaaaaccacacaacaaaacaaacgaagcatacaaaaggccgcacacacacgacgaagaaacgacaaagaagcgaacaaaagacagaaaaagcacaacagcaagacaacataacacaaacaacaatgcaaaggaagcaacagacaaaaaaagagacgacacaaaaaacgaaagcacacgaaaaaagaaggaacaaaacaagcaaaaaggacgaaaaagaagagaagagagaagcaagagaaaaagaacaaaaacgaacagaagaacagacagaaaaaaagaaaagcagaaaaccaacagacaacaaaaa

SEQ ID NO: 405502 - DNA, 2683 bp, Homo sapiens
gaattcggcacgaggttagcaataaggctggagaaggaaaagccggcgcgcccgcggcccgcgcgatttcccgccgagcccgcgtccccggcggcgggcgggctccgggggcgcccgggccgcggcggcgcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaatttcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaattcactgatgttcagttctattttattttgccttcagaaaagaagaaagtcaaaaataaaacttttgtgtattacagcaaaaaaaaaaaaaaaaaaaaaaaaaaaaaaaaaaaaaaaaaaaaaaaaaaaaaaaaaaaaaaaaaaaaaaaaagggggggcgcccccacaaacataaaacccaagagaggagcacaccaaaagaaaagacaacacagtaacaacaacaacagggagcgacaaaaagagaaacaataaaaaacgagagaaaaagcgagcgcacaaaagaaaaaacaaagaggaggaggaaaacaagcacgcacgaacgacacaaaaaggagagaagaacaagcacaaagacaagggaagacgcaacaaacaacgagaggacacacaaaagaaacgaaaagagacaagacacacaaaggaaagagaaaaaaccacacaacaaaacaaacgaagcatacaaaaggccgcacacacacgacgaagaaacgacaaagaagcgaacaaaagacagaaaaagcacaacagcaagacaacataacacaaacaacaatgcaaaggaagcaacagacaaaaaaagagacgacacaaaaaacgaaagcacacgaaaaaagaaggaacaaaacaagcaaaaaggacgaaaaagaagagaagagagaagcaagagaaaaagaacaaaaacgaacagaagaacagacagaaaaaaagaaaagcagaaaaccaacagacaacaaaaa

SEQ ID NO: 405503 - DNA, 1972 bp, Homo sapiens
gaattcggcacgaggttagcaataaggctggagaaggaaaagccggcgcgcccgcggcccgcgcgatttcccgccgagcccgcgtccccggcggcgggcgggctccgggggcgcccgggccgcggcggcgcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaatttcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctatgattgacattttctgctcggcagagttcagggactggaattgcaagagtattttcatgcgtgttgaagatgaactggaaatccctccggcacctcaatctcaacatttccaaaactgaactcatcacccctttagccctcccagctgcctgctaccccttcctgtgtgctgttctattgatccatttctagggtgtcctctgccctat

SEQ ID NO: 405504 - DNA, 1231 bp, Homo sapiens
tctcgaccaataggaagtaggctaaggcgcagaggcggaaagtgtggctacatgagcaggcgtcagagccaatcagccttgagcctcgttcccgtcgtccagcccgcggcgagagcgggtatgtgggcgggaggccggagcagctgtcaggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttg

SEQ ID NO: 405505 - DNA, 625 bp, Homo sapiens
tctcgaccaataggaagtaggctaaggcgcagaggcggaaagtgtggctacatgagcaggcgtcagagccaatcagccttgagcctcgttcccgtcgtccagcccgcggcgagagcgggtatgtgggcgggaggccggagcagctgtcaggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttg

SEQ ID NO: 405506 - DNA, 991 bp, Homo sapiens
ggcggccgagaggtccaggcgccggtggtttttcttttggtcccgctgttccgccacggtccgaaccaggataatgcacttcaaggcggagtctgggccattcgaaaatctccagccacactgcccaaggacttcggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttg

SEQ ID NO: 405507 - DNA, 269 bp, Homo sapiens
ggtctggggaagggggagctaggacctgtctttcctttggtcttatcaccacctcttccaggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacgggtgagggctccttgcctctggctttatcagcaccaggctg

SEQ ID NO: 405508 - DNA, 1778 bp, Homo sapiens
tctcgaccaataggaagtaggctaaggcgcagaggcggaaagtgtggctacatgagcaggcgtcagagccaatcagccttgagcctcgttcccgtcgtccagcccgcggcgagagcgggtatgtgggcgggaggccggagcagctgtcaggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgaaaaaaaaaaacaaccaaaacaaacaacaaacacgatatactcagtaaacagaaatggaaataacaagagaggggggggggcccatttataaaaaattacccccggggggggcgccaataatataagtacacacccagatgattttatcgataacaacggtgggcccccaaaaagagggtgaggcttatatatcagcttctactagcgcgggggcagcactatataacaacagctgcgtagttcggctgggaaacaacacgtgtgtccgacgcctgcagcgaatcatcttttggaggaagaaagccaccacccaaatacatcacaggggggggggggccgaaccactatattggcgcccaacaacttccatcccagcagcagaactattatcgaacgcctccagggaggcgaggaaataatatagacccatgttcgtgcaggtgcatcaatatgagtgggtagaacccacaccaggtagactatcgcacggtcaggtacaggaaaattgggtagcaagaggcgatacatgtagaagaaacttttgcc

SEQ ID NO: 405509 - DNA, 1209 bp, Homo sapiens
tctcgaccaataggaagtaggctaaggcgcagaggcggaaagtgtggctacatgagcaggcgtcagagccaatcagccttgagcctcgttcccgtcgtccagcccgcggcgagagcgggtatgtgggcgggaggccggagcagctgtcaggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagaggggactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttg

SEQ ID NO: 405510 - DNA, 778 bp, Homo sapiens
caggtcaccatgttttctaaaatagccgaaagattcccacatagctgaatctagtaaaatgattctcatccttggtacacaagcagaatcacctggggaactctaaaaaatactgatgcttaggcccccaccattcccatttcattggttagggaacagcttgggcatggggaggtttaaatgctccccattgattctaatgagcagccagggttgagaatcactagccacactctacactacaaccttacctgcttttgaaaaagggtaaaatgcgcagtctaataatgtagggaaccttgccaaaccctgagctccaccctagaattgaaatcatagcaatggaaaccttttatgtttatcttcttttttttcttttttgagatggagtctcgctctgttacaaggctggagagcagtggtgcaatctcggctcactgcaaactccacctcccgggctcaagcaattctcctgcctcagcctcccgagtagctgggattacaggcatgagccaccgcacctggccatttctttatcttttataggtgcatgatctgcagggtaacacatacagaaattattttgtgtggcatcataattccatgccctattaaagggtggggactggaatttatccactgccaacctaaccccatatgtgaactcagaacagaaaaaatgctcagaaaaaagggtggtctgtgattgacaaatagaacccaggattgtaaatacatttgctggtgttcagtaaagtttagtaaagttgaatttcat

SEQ ID NO: 405511 - DNA, 167 bp, Homo sapiens
cgaggctggccctgggtcattgcgtggtctgggctgaagacagcagtagcctgtgctggcacacagctgtggagctggagggagatgggagggttcagagtgtagcgtggaggtaaactgatcaggcttgctgatggatcagatgttggggaatgaaaaaggatagg

SEQ ID NO: 405512 - DNA, 717 bp, Homo sapiens
ggtttgcaaagggagtagcctccagtccttctgttacttaggtgtggaaagttggggttttccttttgatttagttctacgaagtcagagtgaatcagccttaggttccctgcctccagaccctattctcctgcctcacaagagttgaagaaagaccaccagtgaaatgttgataagccgaggtatagatgagaatcccaaactgagacagcttaagaaatgtccagagtcttgtaacaagtgaaaatgtcatatgtcatgaggtcatgttggaaaaccttaaagaggataaaagatcttccacaagcaacagtacttccccttcctgctgccatgtgaagaaggacgtgtttgcttccccatctgctgtgattataagttttctgaggcctcctcagccctgcagaactgacatccaagctgcatgaggagaggctcacgtagggggaaaccgaggtttgcagcagcgactcgccaggcgtgtgagtgagccaacctggaagcagatcctccagttccagtgaagtgtgtggatgacatcagctccagccttcattttgaccacaactcatgagatgccctaagccagaaccacccttgaagctgcttttaaattccgaaagtggaaataatatattttattgttttaaatcactacattttggggtagtgatttgttttgcatgccatttgttatgttgcaatggataaccaata

SEQ ID NO: 405513 - DNA, 492 bp, Homo sapiens
gagtgaaagataagactaattatactgcctgtatgactgagaaagaaggatgaccttgtcccatatgctaaaggacctgaaatctagagaacaacttgacacatctatttccagccagagcagcagtgactggcaggaagacaaagaggaggcgggtctataaggaagacgtctggttggcagcggacatccaagctgcatgaggagaggctcacgtagggggaaaccgaggtttgcagcagcgactcgccaggcgtgtgagtgagccaacctggaagcagatcctccagttccagtgaagtgtgtggatgacatcagctccagccttcattttgaccacaactcatgagatgccctaagccagaaccacccttgaagctgcttttaaattccgaaagtggaaataatatattttattgttttaaatcactacattttggggtagtgatttgttttgcatgccatttgttatgttgcaatggataaccaata

SEQ ID NO: 405514 - DNA, 456 bp, Homo sapiens
agtcctgagggccaagatggcaaactggttccaccaagccaagcaagcccaaaccatcgctacccaggatggaagcctcatttcgccagggccacccatgaggcaagcgaatgaaatattcacctggactcaccatcatcaacacttcaagaaaactgtggtttggatgatcaaaaccatttaccatcccagccagcctgcccccttccaaaagaaagagcatgtttcagcaccaactcctacaaagaagagtgactgctttaaaacagggacggtcagatgggctaatttcctgaatgtttcccaaatatttcttttcatttcttcctataagagatgctttccacaaataccaaggtattgattttccaattgatcgaggtggagaatgtttcatacagttatgactcctgacaagtggggaataaaaagccaatcataatgaaatcatttact

SEQ ID NO: 405515 - DNA, 298 bp, Homo sapiens
tcaggtccagcaaaggtgtggagatggggatgctcagggcttatgagtacacggggttgtctgaagcaagtggtatatgaaaggagcaattggaaataggacagcaaaaaagccaacaacagtggcaggagggggccttgaatgggaggtaagtggtatctgctcccttgtaagtagtggggagtaactggaagtgtctacacacaataggagattgacttgggttatgtttagaaagattgatagctggacttcgtgctttagtgggaaaatcaatgaactcaaagtatgatggata

SEQ ID NO: 405516 - DNA, 192 bp, Homo sapiens
tggcagcaatggaacacactctgcagtgccctgccccccaccgtggcccacacctgctccaccacctgacagactgacccatgcgggagcgcgatttacatctgttgaatgaatgagtaaatgaatggcacccagttttattgttatgactgtttcttatgccaggctttggaaaacactggattgggtgct

SEQ ID NO: 405517 - DNA, 593 bp, Homo sapiens
accattgcatttagttgcatctgaccttcaaaagaacagaaactgcttgaaggcaagggtattgtttgctatttcctgccaatatacaccaggcttgggacggtgctccatgaatgaccagctcttaaaaatgtccttgcacaaatgatttgcctctcccctggctctgaagcagcctgccatataaagaagctgtttttattttgtactcttcttaataaatcacaaaatcttctgaatttgcaattttggaagtttaagaattatttctttaaatgatatgtttataatgagatttatagaaacataattccccaaacaagctcctgtatcattttagattctcataattggatctggaactttgatgattcttcagaatctgaatgttttttttccttccctaaggaagaagttttgtggagaagatgagggctgattctgtgatttctctgaattagggtgtgaggcaagctggcttttggtttagaaccatgggatttagctggggcatcctgcaatcgcctgatgttttcagcattaagatggaaacaaatactttaagagagaaaattgcttaagtgaaaccatgt

SEQ ID NO: 405518 - DNA, 8192 bp, Homo sapiens
  misc_feature (7146)..(7146): n is a, c, g, or t
  misc_feature (7204)..(7204): n is a, c, g, or t
  misc_feature (7431)..(7431): n is a, c, g, or t
  misc_feature (7471)..(7471): n is a, c, g, or t
  misc_feature (7566)..(7566): n is a, c, g, or t
gccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccagagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagcgtgtctgccgtgtcctcgttcccctctccctcactcctgcttccaccgcagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaattctagtgctggcagacactggctttttatttttaggataagaaaacaggcatattctttgtggtccattatctagagcccatacttgggcagcatttgaaatttcaccttaaccacagacagggctccagggaagtggagatgtaattcttacaacaacagttctgatcatggccatggtgatgactttccaggtctcgtgttcaagtggtgccagaatgcaggagccggtgggcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggataggagggagccacagttcttgcttagctgtgctcacgaccggcttgcagtcctgtgtttcttaagattgtatttggaatggtaatatccttagaattttgggatattgagcttcatggattttctctccaaaacaagccagcacaactaactgtagcagaattgtatccactcattcattcaactgagatgaagtgccctcccttttccagggcctgggctagttcctggaatgcaacagagatttccgtggacacagtctctagtctcacagagcatatagtctagtccacgattggcaagctgcaaccacagacccagtccggcactctgcccatttttctaagtgaaattttcttggaatacagtcacagctgtttttttaacatggtgtcttggctactttcaggctgcgacgggagaattgaatagttgtgacagagaccacaggcccactgaaagggacaaacagggctgaaaatactcactgtttggccctttccagaatagcaagtttgctggcccttgagctagcctgcctttatggggttttttttgtttgtttttttaagctttcagcttcatgctgctgtatttttagttgaagtgttctgagtaacagtcagtgtataaaaggggattgcagaaaaaaatgagggcttgctttactcaacagaaaatatggcccttcctgaatgacactaggagagtcattttatctcatacattcccttcatttcgttggtggacatttgttgaaaccggcactcaatggtcaaaccgtctgtgccctccagttgctgacagtcctgcaggaagatggacaagaggcccagtgctgacagtcacacgactctcactacttgaatgaggggactgtgggtgcaactagaaaatatgttgattcttagccattcccaccttgcctctccgttcagaaccccagctgcgagctgtttgtttccctgcctggaaatgatgttttaggcaggttccttaatttctcaggtctgtctcagataataaaaagctctttgtatgagcctcagaactgtctcttcagtgaatgaaattaccagtcattatacgaagggactttaaaaaatttgtggaaatactgaagtaaaagatgataaaaaaataaaaactttatttcttggctgggcacagtggcttatgtttgtaatcccagtactttgggaggctgaggtgggaggactgcttgaggccaggagttcaagaaattagccaggtttggtagtgcatgcctgtagtcccagctacttgggaggcagagggaggaggattacttgagcccaggagtttgaggttgcagtgagctgtgatcacaccactgcactctagcctggacaacagagcaagatcctctctcttaaaaccaccaacaatgacaacaacaaaacaacatttttatttctcaatgtaagctccatcaagntcaagatacttttgtaagctgtgacaccagccatttagtccacctctaaagaattgcnggctctgggaatttaaccatgtcagtgcagcctttttaacattattaacggaagaaaaaatgagtgcttttaaagattttttaaaatgaggaaacaaagtcagaaggagcaaaatcgggactgtaaggtggatgcctaatgatttcccaacaaaactcttgaagaattgcccttatttgatgagaagaatgagccaggagcattgtcatcgtggagaaagacactgntgaggctttcctgggtgtgtttttgctaaagcttcggctnactttctcaaaacactctcataataagatgttattgtggccagatgcggtggctcacgcctgtaatcccagcactttgggaggctgaggtgggcngatcacgaggtcaggaaatcgagaccatcctggctaacatggtgaaaccccgtcccgtctccactaaaaatacaaaaaattagctgggcgtggtggcaggcacctctagtcccagctactccagctactcggaaggctgaggcaggagaatggcgtgaacctgggaggcagagcttgcagctagctgagattgtgccactgcactccagcctgggcgacagagcgagactccatctcaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtc

SEQ ID NO: 405519 - DNA, 7267 bp, Homo sapiens
  misc_feature (6221)..(6221): n is a, c, g, or t
  misc_feature (6279)..(6279): n is a, c, g, or t
  misc_feature (6506)..(6506): n is a, c, g, or t
  misc_feature (6546)..(6546): n is a, c, g, or t
  misc_feature (6641)..(6641): n is a, c, g, or t
cagcggaacaagcaaggaaggcagcagagtgggaggggtggagtacagtggcgggatgcccgtgcccccgttctcctgcaacacgatggcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaattctagtgctggcagacactggctttttatttttaggataagaaaacaggcatattctttgtggtccattatctagagcccatacttgggcagcatttgaaatttcaccttaaccacagacagggctccagggaagtggagatgtaattcttacaacaacagttctgatcatggccatggtgatgactttccaggtctcgtgttcaagtggtgccagaatgcaggagccggtgggcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggataggagggagccacagttcttgcttagctgtgctcacgaccggcttgcagtcctgtgtttcttaagattgtatttggaatggtaatatccttagaattttgggatattgagcttcatggattttctctccaaaacaagccagcacaactaactgtagcagaattgtatccactcattcattcaactgagatgaagtgccctcccttttccagggcctgggctagttcctggaatgcaacagagatttccgtggacacagtctctagtctcacagagcatatagtctagtccacgattggcaagctgcaaccacagacccagtccggcactctgcccatttttctaagtgaaattttcttggaatacagtcacagctgtttttttaacatggtgtcttggctactttcaggctgcgacgggagaattgaatagttgtgacagagaccacaggcccactgaaagggacaaacagggctgaaaatactcactgtttggccctttccagaatagcaagtttgctggcccttgagctagcctgcctttatggggttttttttgtttgtttttttaagctttcagcttcatgctgctgtatttttagttgaagtgttctgagtaacagtcagtgtataaaaggggattgcagaaaaaaatgagggcttgctttactcaacagaaaatatggcccttcctgaatgacactaggagagtcattttatctcatacattcccttcatttcgttggtggacatttgttgaaaccggcactcaatggtcaaaccgtctgtgccctccagttgctgacagtcctgcaggaagatggacaagaggcccagtgctgacagtcacacgactctcactacttgaatgaggggactgtgggtgcaactagaaaatatgttgattcttagccattcccaccttgcctctccgttcagaaccccagctgcgagctgtttgtttccctgcctggaaatgatgttttaggcaggttccttaatttctcaggtctgtctcagataataaaaagctctttgtatgagcctcagaactgtctcttcagtgaatgaaattaccagtcattatacgaagggactttaaaaaatttgtggaaatactgaagtaaaagatgataaaaaaataaaaactttatttcttggctgggcacagtggcttatgtttgtaatcccagtactttgggaggctgaggtgggaggactgcttgaggccaggagttcaagaaattagccaggtttggtagtgcatgcctgtagtcccagctacttgggaggcagagggaggaggattacttgagcccaggagtttgaggttgcagtgagctgtgatcacaccactgcactctagcctggacaacagagcaagatcctctctcttaaaaccaccaacaatgacaacaacaaaacaacatttttatttctcaatgtaagctccatcaagntcaagatacttttgtaagctgtgacaccagccatttagtccacctctaaagaattgcnggctctgggaatttaaccatgtcagtgcagcctttttaacattattaacggaagaaaaaatgagtgcttttaaagattttttaaaatgaggaaacaaagtcagaaggagcaaaatcgggactgtaaggtggatgcctaatgatttcccaacaaaactcttgaagaattgcccttatttgatgagaagaatgagccaggagcattgtcatcgtggagaaagacactgntgaggctttcctgggtgtgtttttgctaaagcttcggctnactttctcaaaacactctcataataagatgttattgtggccagatgcggtggctcacgcctgtaatcccagcactttgggaggctgaggtgggcngatcacgaggtcaggaaatcgagaccatcctggctaacatggtgaaaccccgtcccgtctccactaaaaatacaaaaaattagctgggcgtggtggcaggcacctctagtcccagctactccagctactcggaaggctgaggcaggagaatggcgtgaacctgggaggcagagcttgcagctagctgagattgtgccactgcactccagcctgggcgacagagcgagactccatctcaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtc

SEQ ID NO: 405520 - DNA, 6127 bp, Homo sapiens
  misc_feature (5081)..(5081): n is a, c, g, or t
  misc_feature (5139)..(5139): n is a, c, g, or t
  misc_feature (5366)..(5366): n is a, c, g, or t
  misc_feature (5406)..(5406): n is a, c, g, or t
  misc_feature (5501)..(5501): n is a, c, g, or t
taagctagtacgagctgggttgaaattcggccgagggttaatagcaagtatactcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaattctagtgctggcagacactggctttttatttttaggataagaaaacaggcatattctttgtggtccattatctagagcccatacttgggcagcatttgaaatttcaccttaaccacagacagggctccagggaagtggagatgtaattcttacaacaacagttctgatcatggccatggtgatgactttccaggtctcgtgttcaagtggtgccagaatgcaggagccggtgggcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggataggagggagccacagttcttgcttagctgtgctcacgaccggcttgcagtcctgtgtttcttaagattgtatttggaatggtaatatccttagaattttgggatattgagcttcatggattttctctccaaaacaagccagcacaactaactgtagcagaattgtatccactcattcattcaactgagatgaagtgccctcccttttccagggcctgggctagttcctggaatgcaacagagatttccgtggacacagtctctagtctcacagagcatatagtctagtccacgattggcaagctgcaaccacagacccagtccggcactctgcccatttttctaagtgaaattttcttggaatacagtcacagctgtttttttaacatggtgtcttggctactttcaggctgcgacgggagaattgaatagttgtgacagagaccacaggcccactgaaagggacaaacagggctgaaaatactcactgtttggccctttccagaatagcaagtttgctggcccttgagctagcctgcctttatggggttttttttgtttgtttttttaagctttcagcttcatgctgctgtatttttagttgaagtgttctgagtaacagtcagtgtataaaaggggattgcagaaaaaaatgagggcttgctttactcaacagaaaatatggcccttcctgaatgacactaggagagtcattttatctcatacattcccttcatttcgttggtggacatttgttgaaaccggcactcaatggtcaaaccgtctgtgccctccagttgctgacagtcctgcaggaagatggacaagaggcccagtgctgacagtcacacgactctcactacttgaatgaggggactgtgggtgcaactagaaaatatgttgattcttagccattcccaccttgcctctccgttcagaaccccagctgcgagctgtttgtttccctgcctggaaatgatgttttaggcaggttccttaatttctcaggtctgtctcagataataaaaagctctttgtatgagcctcagaactgtctcttcagtgaatgaaattaccagtcattatacgaagggactttaaaaaatttgtggaaatactgaagtaaaagatgataaaaaaataaaaactttatttcttggctgggcacagtggcttatgtttgtaatcccagtactttgggaggctgaggtgggaggactgcttgaggccaggagttcaagaaattagccaggtttggtagtgcatgcctgtagtcccagctacttgggaggcagagggaggaggattacttgagcccaggagtttgaggttgcagtgagctgtgatcacaccactgcactctagcctggacaacagagcaagatcctctctcttaaaaccaccaacaatgacaacaacaaaacaacatttttatttctcaatgtaagctccatcaagntcaagatacttttgtaagctgtgacaccagccatttagtccacctctaaagaattgcnggctctgggaatttaaccatgtcagtgcagcctttttaacattattaacggaagaaaaaatgagtgcttttaaagattttttaaaatgaggaaacaaagtcagaaggagcaaaatcgggactgtaaggtggatgcctaatgatttcccaacaaaactcttgaagaattgcccttatttgatgagaagaatgagccaggagcattgtcatcgtggagaaagacactgntgaggctttcctgggtgtgtttttgctaaagcttcggctnactttctcaaaacactctcataataagatgttattgtggccagatgcggtggctcacgcctgtaatcccagcactttgggaggctgaggtgggcngatcacgaggtcaggaaatcgagaccatcctggctaacatggtgaaaccccgtcccgtctccactaaaaatacaaaaaattagctgggcgtggtggcaggcacctctagtcccagctactccagctactcggaaggctgaggcaggagaatggcgtgaacctgggaggcagagcttgcagctagctgagattgtgccactgcactccagcctgggcgacagagcgagactccatctcaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtc

SEQ ID NO: 405521 - DNA, 6506 bp, Homo sapiens
  misc_feature (5460)..(5460): n is a, c, g, or t
  misc_feature (5518)..(5518): n is a, c, g, or t
  misc_feature (5745)..(5745): n is a, c, g, or t
  misc_feature (5785)..(5785): n is a, c, g, or t
  misc_feature (5880)..(5880): n is a, c, g, or t
gccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccagagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagcgtgtctgccgtgtcctcgttcccctctccctcactcctgcttccaccgcagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttatttgtggaaatactgaagtaaaagatgataaaaaaataaaaactttatttcttggctgggcacagtggcttatgtttgtaatcccagtactttgggaggctgaggtgggaggactgcttgaggccaggagttcaagaaattagccaggtttggtagtgcatgcctgtagtcccagctacttgggaggcagagggaggaggattacttgagcccaggagtttgaggttgcagtgagctgtgatcacaccactgcactctagcctggacaacagagcaagatcctctctcttaaaaccaccaacaatgacaacaacaaaacaacatttttatttctcaatgtaagctccatcaagntcaagatacttttgtaagctgtgacaccagccatttagtccacctctaaagaattgcnggctctgggaatttaaccatgtcagtgcagcctttttaacattattaacggaagaaaaaatgagtgcttttaaagattttttaaaatgaggaaacaaagtcagaaggagcaaaatcgggactgtaaggtggatgcctaatgatttcccaacaaaactcttgaagaattgcccttatttgatgagaagaatgagccaggagcattgtcatcgtggagaaagacactgntgaggctttcctgggtgtgtttttgctaaagcttcggctnactttctcaaaacactctcataataagatgttattgtggccagatgcggtggctcacgcctgtaatcccagcactttgggaggctgaggtgggcngatcacgaggtcaggaaatcgagaccatcctggctaacatggtgaaaccccgtcccgtctccactaaaaatacaaaaaattagctgggcgtggtggcaggcacctctagtcccagctactccagctactcggaaggctgaggcaggagaatggcgtgaacctgggaggcagagcttgcagctagctgagattgtgccactgcactccagcctgggcgacagagcgagactccatctcaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtc

SEQ ID NO: 405522 - DNA, 385 bp, Homo sapiens
tgcttattttgcaatttgggggtattgtcatcctgtaaacggattgcaggaagtcagagaacaagtttttcgattccagttttccattatacagtttttttctatacatatttaggcggatggagccatgacggtagaggttaaaatgtgtgatttagttccatgcttaatttgatttcatctcttataggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagc

SEQ ID NO: 405523 - DNA, 6707 bp, Homo sapiens
  misc_feature (5661)..(5661): n is a, c, g, or t
  misc_feature (5719)..(5719): n is a, c, g, or t
  misc_feature (5946)..(5946): n is a, c, g, or t
  misc_feature (5986)..(5986): n is a, c, g, or t
  misc_feature (6081)..(6081): n is a, c, g, or t
tatgcttagtcgagccgggtttaatcggccgaggcttgccgccgcgttaagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaattctagtgctggcagacactggctttttatttttaggataagaaaacaggcatattctttgtggtccattatctagagcccatacttgggcagcatttgaaatttcaccttaaccacagacagggctccagggaagtggagatgtaattcttacaacaacagttctgatcatggccatggtgatgactttccaggtctcgtgttcaagtggtgccagaatgcaggagccggtgggcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggataggagggagccacagttcttgcttagctgtgctcacgaccggcttgcagtcctgtgtttcttaagattgtatttggaatggtaatatccttagaattttgggatattgagcttcatggattttctctccaaaacaagccagcacaactaactgtagcagaattgtatccactcattcattcaactgagatgaagtgccctcccttttccagggcctgggctagttcctggaatgcaacagagatttccgtggacacagtctctagtctcacagagcatatagtctagtccacgattggcaagctgcaaccacagacccagtccggcactctgcccatttttctaagtgaaattttcttggaatacagtcacagctgtttttttaacatggtgtcttggctactttcaggctgcgacgggagaattgaatagttgtgacagagaccacaggcccactgaaagggacaaacagggctgaaaatactcactgtttggccctttccagaatagcaagtttgctggcccttgagctagcctgcctttatggggttttttttgtttgtttttttaagctttcagcttcatgctgctgtatttttagttgaagtgttctgagtaacagtcagtgtataaaaggggattgcagaaaaaaatgagggcttgctttactcaacagaaaatatggcccttcctgaatgacactaggagagtcattttatctcatacattcccttcatttcgttggtggacatttgttgaaaccggcactcaatggtcaaaccgtctgtgccctccagttgctgacagtcctgcaggaagatggacaagaggcccagtgctgacagtcacacgactctcactacttgaatgaggggactgtgggtgcaactagaaaatatgttgattcttagccattcccaccttgcctctccgttcagaaccccagctgcgagctgtttgtttccctgcctggaaatgatgttttaggcaggttccttaatttctcaggtctgtctcagataataaaaagctctttgtatgagcctcagaactgtctcttcagtgaatgaaattaccagtcattatacgaagggactttaaaaaatttgtggaaatactgaagtaaaagatgataaaaaaataaaaactttatttcttggctgggcacagtggcttatgtttgtaatcccagtactttgggaggctgaggtgggaggactgcttgaggccaggagttcaagaaattagccaggtttggtagtgcatgcctgtagtcccagctacttgggaggcagagggaggaggattacttgagcccaggagtttgaggttgcagtgagctgtgatcacaccactgcactctagcctggacaacagagcaagatcctctctcttaaaaccaccaacaatgacaacaacaaaacaacatttttatttctcaatgtaagctccatcaagntcaagatacttttgtaagctgtgacaccagccatttagtccacctctaaagaattgcnggctctgggaatttaaccatgtcagtgcagcctttttaacattattaacggaagaaaaaatgagtgcttttaaagattttttaaaatgaggaaacaaagtcagaaggagcaaaatcgggactgtaaggtggatgcctaatgatttcccaacaaaactcttgaagaattgcccttatttgatgagaagaatgagccaggagcattgtcatcgtggagaaagacactgntgaggctttcctgggtgtgtttttgctaaagcttcggctnactttctcaaaacactctcataataagatgttattgtggccagatgcggtggctcacgcctgtaatcccagcactttgggaggctgaggtgggcngatcacgaggtcaggaaatcgagaccatcctggctaacatggtgaaaccccgtcccgtctccactaaaaatacaaaaaattagctgggcgtggtggcaggcacctctagtcccagctactccagctactcggaaggctgaggcaggagaatggcgtgaacctgggaggcagagcttgcagctagctgagattgtgccactgcactccagcctgggcgacagagcgagactccatctcaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtc

SEQ ID NO: 405524 - DNA, 8134 bp, Homo sapiens
  misc_feature (7088)..(7088): n is a, c, g, or t
  misc_feature (7146)..(7146): n is a, c, g, or t
  misc_feature (7373)..(7373): n is a, c, g, or t
  misc_feature (7413)..(7413): n is a, c, g, or t
  misc_feature (7508)..(7508): n is a, c, g, or t
gccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccagagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagcgtgtctgccgtgtcctcgttcccctctccctcactcctgcttccaccgcagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaattctagtgctggcagacactggctttttatttttaggataagaaaacaggcatattctttgtggtccattatctagagcccatacttgggcagcatttgaaatttcaccttaaccacagacagggctccagggaagtggagatgtaattcttacaacaacagttctgatcatggccatggtgatgactttccaggtctcgtgttcaagtggtgccagaatgcaggagccggtgggcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggataggagggagccacagttcttgcttagctgtgctcacgaccggcttgcagtcctgtgtttcttaagattgtatttggaatggtaatatccttagaattttgggatattgagcttcatggattttctctccaaaacaagccagcacaactaactgtagcagaattgtatccactcattcattcaactgagatgaagtgccctcccttttccagggcctgggctagttcctggaatgcaacagagatttccgtggacacagtctctagtctcacagagcatatagtctagtccacgattggcaagctgcaaccacagacccagtccggcactctgcccatttttctaagtgaaattttcttggaatacagtcacagctgtttttttaacatggtgtcttggctactttcaggctgcgacgggagaattgaatagttgtgacagagaccacaggcccactgaaagggacaaacagggctgaaaatactcactgtttggccctttccagaatagcaagtttgctggcccttgagctagcctgcctttatggggttttttttgtttgtttttttaagctttcagcttcatgctgctgtatttttagttgaagtgttctgagtaacagtcagtgtataaaaggggattgcagaaaaaaatgagggcttgctttactcaacagaaaatatggcccttcctgaatgacactaggagagtcattttatctcatacattcccttcatttcgttggtggacatttgttgaaaccggcactcaatggtcaaaccgtctgtgccctccagttgctgacagtcctgcaggaagatggacaagaggcccagtgctgacagtcacacgactctcactacttgaatgaggggactgtgggtgcaactagaaaatatgttgattcttagccattcccaccttgcctctccgttcagaaccccagctgcgagctgtttgtttccctgcctggaaatgatgttttaggcaggttccttaatttctcaggtctgtctcagataataaaaagctctttgtatgagcctcagaactgtctcttcagtgaatgaaattaccagtcattatacgaagggactttaaaaaatttgtggaaatactgaagtaaaagatgataaaaaaataaaaactttatttcttggctgggcacagtggcttatgtttgtaatcccagtactttgggaggctgaggtgggaggactgcttgaggccaggagttcaagaaattagccaggtttggtagtgcatgcctgtagtcccagctacttgggaggcagagggaggaggattacttgagcccaggagtttgaggttgcagtgagctgtgatcacaccactgcactctagcctggacaacagagcaagatcctctctcttaaaaccaccaacaatgacaacaacaaaacaacatttttatttctcaatgtaagctccatcaagntcaagatacttttgtaagctgtgacaccagccatttagtccacctctaaagaattgcnggctctgggaatttaaccatgtcagtgcagcctttttaacattattaacggaagaaaaaatgagtgcttttaaagattttttaaaatgaggaaacaaagtcagaaggagcaaaatcgggactgtaaggtggatgcctaatgatttcccaacaaaactcttgaagaattgcccttatttgatgagaagaatgagccaggagcattgtcatcgtggagaaagacactgntgaggctttcctgggtgtgtttttgctaaagcttcggctnactttctcaaaacactctcataataagatgttattgtggccagatgcggtggctcacgcctgtaatcccagcactttgggaggctgaggtgggcngatcacgaggtcaggaaatcgagaccatcctggctaacatggtgaaaccccgtcccgtctccactaaaaatacaaaaaattagctgggcgtggtggcaggcacctctagtcccagctactccagctactcggaaggctgaggcaggagaatggcgtgaacctgggaggcagagcttgcagctagctgagattgtgccactgcactccagcctgggcgacagagcgagactccatctcaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtc

SEQ ID NO: 405525 - DNA, 6627 bp, Homo sapiens
  misc_feature (5581)..(5581): n is a, c, g, or t
  misc_feature (5639)..(5639): n is a, c, g, or t
  misc_feature (5866)..(5866): n is a, c, g, or t
  misc_feature (5906)..(5906): n is a, c, g, or t
  misc_feature (6001)..(6001): n is a, c, g, or t
gccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccagagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagcgtgtctgccgtgtcctcgttcccctctccctcactcctgcttccaccgcagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccataggccagaggcgtggctgccccagcgttagcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggataggagggagccacagttcttgcttagctgtgctcacgaccggcttgcagtcctgtgtttcttaagattgtatttggaatggtaatatccttagaattttgggatattgagcttcatggattttctctccaaaacaagccagcacaactaactgtagcagaattgtatccactcattcattcaactgagatgaagtgccctcccttttccagggcctgggctagttcctggaatgcaacagagatttccgtggacacagtctctagtctcacagagcatatagtctagtccacgattggcaagctgcaaccacagacccagtccggcactctgcccatttttctaagtgaaattttcttggaatacagtcacagctgtttttttaacatggtgtcttggctactttcaggctgcgacgggagaattgaatagttgtgacagagaccacaggcccactgaaagggacaaacagggctgaaaatactcactgtttggccctttccagaatagcaagtttgctggcccttgagctagcctgcctttatggggttttttttgtttgtttttttaagctttcagcttcatgctgctgtatttttagttgaagtgttctgagtaacagtcagtgtataaaaggggattgcagaaaaaaatgagggcttgctttactcaacagaaaatatggcccttcctgaatgacactaggagagtcattttatctcatacattcccttcatttcgttggtggacatttgttgaaaccggcactcaatggtcaaaccgtctgtgccctccagttgctgacagtcctgcaggaagatggacaagaggcccagtgctgacagtcacacgactctcactacttgaatgaggggactgtgggtgcaactagaaaatatgttgattcttagccattcccaccttgcctctccgttcagaaccccagctgcgagctgtttgtttccctgcctggaaatgatgttttaggcaggttccttaatttctcaggtctgtctcagataataaaaagctctttgtatgagcctcagaactgtctcttcagtgaatgaaattaccagtcattatacgaagggactttaaaaaatttgtggaaatactgaagtaaaagatgataaaaaaataaaaactttatttcttggctgggcacagtggcttatgtttgtaatcccagtactttgggaggctgaggtgggaggactgcttgaggccaggagttcaagaaattagccaggtttggtagtgcatgcctgtagtcccagctacttgggaggcagagggaggaggattacttgagcccaggagtttgaggttgcagtgagctgtgatcacaccactgcactctagcctggacaacagagcaagatcctctctcttaaaaccaccaacaatgacaacaacaaaacaacatttttatttctcaatgtaagctccatcaagntcaagatacttttgtaagctgtgacaccagccatttagtccacctctaaagaattgcnggctctgggaatttaaccatgtcagtgcagcctttttaacattattaacggaagaaaaaatgagtgcttttaaagattttttaaaatgaggaaacaaagtcagaaggagcaaaatcgggactgtaaggtggatgcctaatgatttcccaacaaaactcttgaagaattgcccttatttgatgagaagaatgagccaggagcattgtcatcgtggagaaagacactgntgaggctttcctgggtgtgtttttgctaaagcttcggctnactttctcaaaacactctcataataagatgttattgtggccagatgcggtggctcacgcctgtaatcccagcactttgggaggctgaggtgggcngatcacgaggtcaggaaatcgagaccatcctggctaacatggtgaaaccccgtcccgtctccactaaaaatacaaaaaattagctgggcgtggtggcaggcacctctagtcccagctactccagctactcggaaggctgaggcaggagaatggcgtgaacctgggaggcagagcttgcagctagctgagattgtgccactgcactccagcctgggcgacagagcgagactccatctcaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtc

SEQ ID NO: 405526 - DNA, 3565 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405527 - DNA, 1670 bp, Homo sapiens
ttttttttcatagtgggcaccatttattggacatttgccatgtatcagaagctgttccaagcactttatttgctttatctcagctcctctcagcaaccctatggggtaggggatatggtatccctgttgtgtagacatggaagctgaggctcagagagtttacatgcaagggcactttagctaccaggctgactccaaaatccatattcataagtgctagactgtttagctactataaatccctgtaaagtagtgtcactagcctgtaggaccaggatcaaaacaaaacaaatggccacttcagaaatcttgccttcatttgttgccacgatggatgcaagtaatttttctttttggcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405528 - DNA, 3676 bp, Homo sapiens
acaaggggactcagcgccagtgagagtagggacgaaggctcagggaaggcgagcttcggtccaagccgttggggtgtggggaggggaatccatttcgtagacagctctgccgaggcacggagaggggcggtgctgcttggggtcaactgggatttagggcttggattcatttaagaacctgagcttccttcaccaaacctagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405529 - DNA, 3600 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405530 - DNA, 5336 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtaagtgaggattcccattttggatgtcctggccccaagtttcagattttacacatgtaaatgacacagaatcagagttttctggttcctgtaggcagcctaaaccttaggtcacacttttgcacatagcaacagactctcaccctgctgactggggtacatggtcagctggcacccactgcccaggtctaccatgactgagaggggcatcttccctgagtggagactgacttaagctggattcagatgatgtcagtctaaccccaggccccgccctcttaaccactgtgctgtgtggccttttaaggctcattcatgcctgagcatgctgcttaggtgacgcatctttacagtgtggagtttggcacgcggtctgacacttggtgattgctcagccttaatcagccccattttacctgttaaacagtaagatctactttataggctaaaagggagagtgagttcatgcttgtgtatagccttcaataggtggtgtctgtgttgtcaaaaacaggcagttcactgttcgtgtactatatctattcccaagttctaggtaagtcattctgcctagatcataagtaagtgagagtatatttatgtttctacatttgggagcctatttcaaccagtcctgtgctccagtgttgctcattagccgattcgcagcattgaaatgggatcgtctagtctgtgttttacagataagcccagcgaggctgagagcctgttcaaggtcacatagttaaagggtggcagttagaactggaatttctatttcctgagtctttaattcttgttatttaatagcctaggccaggcacggtggctcacgcctgtaatcctagcactttgggaggccgaggcgggtagatcacgaggtcaggagttcgagaccagcctgaccaacatggtgaaaccccgtctctactaaaaatgcaaaaattagccgggcgcggtggcacatgcctgtaatgccagctacttaggaggctgaggcagaagaatcgcttaaacctgggaggcagaggttgtagtgagccgagattgcaagcactgcactccagcctaggtgacaagagcgagactcggtctcaaaaaaaaaaaaagaaaaatagcctattctgtgaaaacagagattaagtaataaggcaaatatacttctctgcttctgtaattatcaagttttttctaaaaactcttccttagctacccttggcctcatgtttccaaaactgttccctgaatatacccctcaattagcacttagcatttatggtcttggtattatcctttaaacactcatttcagctccctaaatatatgtgaacttctttcaggatgggggccctgtgtgggtaggttaaaaataaagccagtgtgggccctatgttttcaaggtactaaaagctgcctctttggtggtgggaaatggaaactctacagagcaaggtgggaacagaagagtggctgaggactctctgttaatgtttccagctctgaaggaagaaatcccttgcagatacttcattttaaaatgttgaatattaataatctggttactagatactagccaggaaccttctgaacagtttttatgtgatactggccagtcgtctaaacttcctccaaagttgtatctttgaggcagagctgcccttcagtgagtcacaagcactctggcacacccaagacctgggccaagccacagtgtcaacttccatacacctggaaacacctctcctcaccgccctgtcctcctgtatcttaggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405531 - DNA, 3248 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405532 - DNA, 3441 bp, Homo sapiens
ttttttttcatagtgggcaccatttattggacatttgccatgtatcagaagctgttccaagcactttatttgctttatctcagctcctctcagcaaccctatggggtaggggatatggtatccctgttgtgtagacatggaagctgaggctcagagagtttacatgcaagggcactttagctaccaggctgactccaaaatccatattcataagtgctagactgtttagctactataaatccctgtaaagtagtgtcactagcctgtaggaccaggatcaaaacaaaacaaatggccacttcagaaatcttgccttcatttgttgccacgatggatgcaagtaatttttctttttggcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtaagtgaggattcccattttggatgtcctggccccaagtttcagattttacacatgtaaatgacacagaatcagagttttctggttcctgtaggcagcctaaaccttaggtcacacttttgcacatagcaacagactctcaccctgctgactggggtacatggtcagctggcacccactgcccaggtctaccatgactgagaggggcatcttccctgagtggagactgacttaagctggattcagatgatgtcagtctaaccccaggccccgccctcttaaccactgtgctgtgtggccttttaaggctcattcatgcctgagcatgctgcttaggtgacgcatctttacagtgtggagtttggcacgcggtctgacacttggtgattgctcagccttaatcagccccattttacctgttaaacagtaagatctactttataggctaaaagggagagtgagttcatgcttgtgtatagccttcaataggtggtgtctgtgttgtcaaaaacaggcagttcactgttcgtgtactatatctattcccaagttctaggtaagtcattctgcctagatcataagtaagtgagagtatatttatgtttctacatttgggagcctatttcaaccagtcctgtgctccagtgttgctcattagccgattcgcagcattgaaatgggatcgtctagtctgtgttttacagataagcccagcgaggctgagagcctgttcaaggtcacatagttaaagggtggcagttagaactggaatttctatttcctgagtctttaattcttgttatttaatagcctaggccaggcacggtggctcacgcctgtaatcctagcactttgggaggccgaggcgggtagatcacgaggtcaggagttcgagaccagcctgaccaacatggtgaaaccccgtctctactaaaaatgcaaaaattagccgggcgcggtggcacatgcctgtaatgccagctacttaggaggctgaggcagaagaatcgcttaaacctgggaggcagaggttgtagtgagccgagattgcaagcactgcactccagcctaggtgacaagagcgagactcggtctcaaaaaaaaaaaaagaaaaatagcctattctgtgaaaacagagattaagtaataaggcaaatatacttctctgcttctgtaattatcaagttttttctaaaaactcttccttagctacccttggcctcatgtttccaaaactgttccctgaatatacccctcaattagcacttagcatttatggtcttggtattatcctttaaacactcatttcagctccctaaatatatgtgaacttctttcaggatgggggccctgtgtgggtaggttaaaaataaagccagtgtgggccctatgttttcaaggtactaaaagctgcctctttggtggtgggaaatggaaactctacagagcaaggtgggaacagaagagtggctgaggactctctgttaatgtttccagctctgaaggaagaaatcccttgcagatacttcattttaaaatgttgaatattaataatctggttactagatactagccaggaaccttctgaacagtttttatgtgatactggccagtcgtctaaacttcctccaaagttgtatctttgaggcagagctgcccttcagtgagtcacaagcactctggcacacccaagacctgggccaagccacagtgtcaacttccatacacctggaaacacctctcctcaccgccctgtcctcctgtatcttaggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405533 - DNA, 3293 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtaagtgaggattcccattttggatgtcctggccccaagtttcagattttacacatgtaaatgacacagaatcagagttttctggttcctgtaggcagcctaaaccttaggtcacacttttgcacatagcaacagactctcaccctgctgactggggtacatggtcagctggcacccactgcccaggtctaccatgactgagaggggcatcttccctgagtggagactgacttaagctggattcagatgatgtcagtctaaccccaggccccgccctcttaaccactgtgctgtgtggccttttaaggctcattcatgcctgagcatgctgcttaggtgacgcatctttacagtgtggagtttggcacgcggtctgacacttggtgattgctcagccttaatcagccccattttacctgttaaacagtaagatctactttataggctaaaagggagagtgagttcatgcttgtgtatagccttcaataggtggtgtctgtgttgtcaaaaacaggcagttcactgttcgtgtactatatctattcccaagttctaggtaagtcattctgcctagatcataagtaagtgagagtatatttatgtttctacatttgggagcctatttcaaccagtcctgtgctccagtgttgctcattagccgattcgcagcattgaaatgggatcgtctagtctgtgttttacagataagcccagcgaggctgagagcctgttcaaggtcacatagttaaagggtggcagttagaactggaatttctatttcctgagtctttaattcttgttatttaatagcctaggccaggcacggtggctcattgggcagcttctccacgtgcagggccacggaacccgcc

SEQ ID NO: 405534 - DNA, 2340 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttag

SEQ ID NO: 405535 - DNA, 411 bp, Homo sapiens
agagaaccctgactaatacaatgattaacctaatcatgggactaaagtagaagctatcgtttcttgagcacttattttgaactcattgaatttgctttgtaagccttctctaaggttggtatggtagttaatcccaatttaagaaagacaactgaatctggtcacccagctactgtgaggtagattctctatatcaatctctggacatctgactattaaaatagtgttcataattactacagtctttcagttcatcagaagaaattcatgttttgtgaggaaaactgaaaattttgtttcatcaagtaatgtatttcaaaaagcatattctaaaaaaaatcactctcctaggaccaccaaggatccagatataattctttcctcagtaatagaaaaaagaatctgggatct

SEQ ID NO: 405536 - DNA, 2961 bp, Homo sapiens
acaaggggactcagcgccagtgagagtagggacgaaggctcagggaaggcgagcttcggtccaagccgttggggtgtggggaggggaatccatttcgtagacagctctgccgaggcacggagaggggcggtgctgcttggggtcaactgggatttagggcttggattcatttaagaacctgagcttccttcaccaaacctagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttag

SEQ ID NO: 405537 - DNA, 3642 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggttcttcagctttggaacttgactggctctccttgctcctcagcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405538 - DNA, 3107 bp, Homo sapiens
ttgactggcgcagatgaagttgactggcgcagagtagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405539 - DNA, 3356 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaaagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaacgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 405540 - DNA, 2640 bp, Homo sapiens
  misc_feature (2555)..(2555): n is a, c, g, or t
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggcggcggcggcggtagcaagngcgtgtggtggcgcgggatcttgggggcctcggcgctgaccagggggacttggcgaccctccgttctgttgctgccggtgaggcg

SEQ ID NO: 405541 - DNA, 723 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgagcctgatcgacatggccaagtgaactgtggcaggtccagaaccagtcagagacttgcccctaagagggatgtactgtaaataaacagtatttttag

SEQ ID NO: 405542 - DNA, 315 bp, Homo sapiens
tagctaaacatggcaggagaaaaacacaactatactgactagcctcgcttgacattcatgaagccaatctcaagcttaggacttgcttcctagtctgtctattgcctctcttgcttccttatatcttctcctctttcctcaaacctctgacatcaccttctcacatgtagagtgagctttttaaaactgtgaaaatggaagcaaccagaagagaattccataaacttctataactcaaccatcatcatttgaacttcgtcttatatcttctgtctttcctcctattactctggaagaattttcccagttcttaag

SEQ ID NO: 405543 - DNA, 719 bp, Homo sapiens
actgctttactgaggcatagtttatataccacaaaatccacacattataagcatccaatttaatgatatttaatgatttttagtaaatgtatagagtagtacaaccattaccataatttagttttagaaacaagttcaatttgaaaaaaatagtgctttgaaaaggtatcactgcttgcccattatagcactatagggtttattcttactgataatctgcctaaagtaggctccacaaaacactgggtaagggcagccacgctttggaggacttcctctttccctggcttctgagtgattatgtgctgggattcaggagtgagctcagagctcaccacctcgtgctcaggctcagggaggggcccttggtgtggacatggaaatccctgccatgtccatagcctctatgctcaccacctggaaagttacagagagctcccagttacacctctggtttctagagccagtagagcaagcctgtgatcagcccctccaccccagcctcctacagccacctctcccaggaaagcctagaggaaattggccaacgtcttggtattccattctggttgccaagtgcccttattgtttttgcatttctaagagactgtcagtacaacttcccccgtgactgccacgtgacaggctgtgctgtcctttatctcagggcaccaaatgacttacttcattccaggtctttctgtttcactgtgagtcag

SEQ ID NO: 405544 - DNA, 250 bp, Homo sapiens
tgcacctgctaaatggatttgctcaaacaaaatcttaactactttgtaacacaaatttacaaagaggacaagctctgttacaaaaagagacaacaattaatccagactcaataataaataagattttaagtttctctaacactcattttaaaataaatatttgaaaagaacatttaatccctctataaatccccaagatacatgatctgaacttccacatataacatactgtgtagaacatttgacatta

SEQ ID NO: 405545 - DNA, 468 bp, Homo sapiens
gaagaagaatataggctatgagtggtggcatgttcctgcagtccaagctactcaggcagttgaggtgggaggatctcttgagcccaggagagattggtagaatgtattaaatgaataggtggatgacagagccttgggaaatgtaaaaaaattagttaaataaaataaaacatgatccatctatatactgtctataaatacagacttactttagatacaaagacacaatgagattgaaaacaaaagaatgaagaaatgaattccatgccttgctaagtttttgtgtttttagtggagatggggttttgccttgttggccaggtcagtctcgaactcctgaactgaggtgatccatcctcctcggcctcccagagtgctgagattgcagcatgagccaccgcgcccagcccttatcttggatttccagactccataaccaagagaagtaaatttctgttgtttaagcca

SEQ ID NO: 405546 - DNA, 365 bp, Homo sapiens
gaagaagaatataggctatgagtggtggcatgttcctgcagtccaagctactcaggcagttgaggtgggaggatctcttgagcccaggagagattggtagaatgtattaaatgaataggtggatgacagagccttgggaaatgtaaaaaaattagttaaataaaataaaacatgatccatctatatactgtctataaatacagacttactttagatacaaagacacaatgagattgaaaacaaaagaatgaagaaatgaattccatgcgagtgctgagattgcagcatgagccaccgcgcccagcccttatcttggatttccagactccataaccaagagaagtaaatttctgttgtttaagcca

SEQ ID NO: 405547 - DNA, 698 bp, Homo sapiens
cttctaaaattaaaaacaacaaacaaacaaacaaagaaccttcaacattctcaccctggaagaaaagactgcttgccaaattcaaatttgccttggccaaagtaaccattagcaactcatcctttaaatgagattataaagaaagaatttccccttgaagttggagaaaacacctttcatgtgacctccaaactatgttacttattttaaagttacacaaaacaaacttgtctttttcagtttttgcttactcccaagccgtgctgcttacagaagtgtatgggatgaggagccagcaggatggtaaccttgagggagaacagggggcccggggtccctagatgctggtcaggttctgcttatccaggggttggtagttgtcccacaggtaagcttgcggtggaaactcattccaatgcatacgtgagttttgtgctctctgaacatatgctacacctcaataaaaagtttacttgcaaccaagacagaacaaaatacccactgcctctcagaagataacaaaactacctttgtatgtatgcacagcctgcagagaagcacgcgtccagaaacacccggcacatgtaacacacacacgttaccacagcaggcggcagctggacccacagaggaccaaactccatccctgaacagaatcactgtgcagctccaatctgtcactcccgaagacatttttg

SEQ ID NO: 405548 - DNA, 3927 bp, Homo sapiens
ggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggcatttctggagaatgtgtgtatatacatgtttgcgcgtacaggggaggggagggtatgataaatgtgggaaactggaaatatattgacttttatgtttataatcttggtagcatttagaatgcccctaagaaatctccattgacaaatgaaatgctatagacttggttttccagttatccatattcattttgtctgtcatatgctttgtatcatctccttctttcctaattttttataaccttatatatatatttattataaatatatgtatttctgaggga

SEQ ID NO: 405549 - DNA, 2150 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagctt

SEQ ID NO: 405550 - DNA, 560 bp, Homo sapiens
ctagaggatcccccaaagatgccatcgactggatttattttgaagagttttgccacttttgggattataaggaacaaatcacaggaaaagccagaatcagtaagctatataaagggcttgttgcattccactgtcactacacatttagcctggtagcttcctgttttcttttctttttattttttaaatagagatggggtctgtatgttgaccagcctggccaacatggtgaaaccccatctctactaaaaatacaaaaaattagccgggcttggtggcatgcgcctgtaatcccagctgtaatcaagaggctgaggcaggagaatggcttgaacccgggaagtggaggttgcagtgagccgagattgtgccattgcactccagcctgggcaacaagagtgaaactctgtctcaaaaaaaaaaaaaaaaaaaaaattccggcagggggggggggggcgcctataaccccagttactcgggaggcagaggacaagaagggctggatcattggacccggggaggcagagtcacaaggacgcgagatgggccatggactcaag

SEQ ID NO: 405551 - DNA, 337 bp, Homo sapiens
ccggaccagaatgtgtataacgaccttaaagttacactgactataccacacgttattctcctgattcgtatgattggaaatatttaaaagttctcaggtaagcggtagcttgatgtgaagtaccagagggaaaggtttaaagtcctggatatggcttgagataattagtaggcatgtaaattgcctttcatttactttggattacttcagcaatagctgagaaaccataaaggaaacacatttggttaagtaacacattgtatgaggccaggtttcaaacctgtggtagcatacagaagataattggttattcttatttttgtcgttgttggtttgt

SEQ ID NO: 405552 - DNA, 7513 bp, Homo sapiens
cctccgtgacaggcattcacttctgccctaagtgtgtcagaaagatcccattttgtttcctaactcaggccaaccctcctttgcctccaaaattcagtgttaactaaccaattacttaagagacggatccctcttccttctgtggatagttcatctgttaaggatccattatcacctgtctcactcctcctaaggagtcctagtataaaagggccagggtaggagtagggaagctggttggcatggagggtcacaagatccagaatggctagggatggaaaaagaataccctggttctttgggggattctgccaaaggagctttattgaccatttttttaaaggaaaaacactgaatgatcttgaggatggtaaactgtctcctcttctgggttccagaagcccttatgctacgttcagtattaagaaaagccctgaacaagtggaggatgctgctttcatattctttcatagcagtaatacactggtgcttggtacttatgttagtgctaactccagctttgaccatagtatctgtaccagttggagggttaaatttaatagtagtcccagtaggagcagctgtaaaactacttggcccaaagagggagccagatgtgctgccaaaaggattagaggtggtatttgtggttccaaggagtcctccactgctagtactggttccaaaattgccaaagccagttggtttattttgtccaaatgttgaagttgtgccaaagccacctgtgccacccccaaagggtgttccaaatgatttgttaaacatcttcaaaatgagtctttgtttcagaaagcgcggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcagggagcatttcaatgactctaatatagtccaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405553 - DNA, 7016 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405554 - DNA, 5230 bp, Homo sapiens
aaatatactcgtgtgcacaccaggtcggcttcttcaacacatggatgaaacagtatcttttcatgctaccgacctccaaatgttagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405555 - DNA, 4620 bp, Homo sapiens
ttcttcaaacctatttgaccatgaagcttttcacacacacacacacacacacacacacacacactcacacaccccttctcctaggaatcatgtttggtagaaaagtagtttggaaaattcttcattctgatatattttctctttatatgatgatttagttgctgattatttcaggttatttttttttctgtttttttttttttttttgtcacaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405556 - DNA, 7291 bp, Homo sapiens
cctccgtgacaggcattcacttctgccctaagtgtgtcagaaagatcccattttgtttcctaactcaggccaaccctcctttgcctccaaaattcagtgttaactaaccaattacttaagagacggatccctcttccttctgtggatagttcatctgttaaggatccattatcacctgtctcactcctcctaaggagtcctagtataaaagggccagggtaggagtagggaagctggttggcatggagggtcacaagatccagaatggctagggatggaaaaagaataccctggttctttgggggattctgccaaaggagctttattgaccatttttttaaaggaaaaacactgaatgatcttgaggatggtaaactgtctcctcttctgggttccagaagcccttatgctacgttcagtattaagaaaagccctgaacaagtggaggatgctgctttcatattctttcatagcagtaatacactggtgcttggtacttatgttagtgctaactccagctttgaccatagtatctgtaccagttggagggttaaatttaatagtagtcccagtaggagcagctgtaaaactacttggcccaaagagggagccagatgtgctgccaaaaggattagaggtggtatttgtggttccaaggagtcctccactgctagtactggttccaaaattgccaaagccagttggtttattttgtccaaatgttgaagttgtgccaaagccacctgtgccacccccaaagggtgttccaaatgatttgttaaacatcttcaaaatgagtctttgtttcagaaagcgcggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcagggagcatttcaatgactctaatatagtccaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405557 - DNA, 6735 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaaccttgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405558 - DNA, 6810 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405559 - DNA, 7237 bp, Homo sapiens
cctccgtgacaggcattcacttctgccctaagtgtgtcagaaagatcccattttgtttcctaactcaggccaaccctcctttgcctccaaaattcagtgttaactaaccaattacttaagagacggatccctcttccttctgtggatagttcatctgttaaggatccattatcacctgtctcactcctcctaaggagtcctagtataaaagggccagggtaggagtagggaagctggttggcatggagggtcacaagatccagaatggctagggatggaaaaagaataccctggttctttgggggattctgccaaaggagctttattgaccatttttttaaaggaaaaacactgaatgatcttgaggatggtaaactgtctcctcttctgggttccagaagcccttatgctacgttcagtattaagaaaagccctgaacaagtggaggatgctgctttcatattctttcatagcagtaatacactggtgcttggtacttatgttagtgctaactccagctttgaccatagtatctgtaccagttggagggttaaatttaatagtagtcccagtaggagcagctgtaaaactacttggcccaaagagggagccagatgtgctgccaaaaggattagaggtggtatttgtggttccaaggagtcctccactgctagtactggttccaaaattgccaaagccagttggtttattttgtccaaatgttgaagttgtgccaaagccacctgtgccacccccaaagggtgttccaaatgatttgttaaacatcttcaaaatgagtctttgtttcagaaagcgcggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcagggagcatttcaatgactctaatatagtccaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctt

SEQ ID NO: 405560 - DNA, 2767 bp, Homo sapiens
ctattcagtctataggtaatttaggttaaactactttgcaaattttctatccaagcagaaaatggtaagtttttgatcaatattttggcactactgcagaaagcagttaacaatgttaaatcctcccttctgaaggctggaagaaatgaagataatgcccccaagtgtttgacgaagtccataaacccttagtaataaccaaaaaacttccatttctcttataggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405561 - DNA, 2151 bp, Homo sapiens
gagattgtcccactgcactccagcctgggtgacagagtgagactgcctctcaaaaaaaaaagaagaaacataatggcatctagtaaaactgattaggagctaatgtattgttttatcaaattattccttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405562 - DNA, 1572 bp, Homo sapiens
gttgtttcaaggttttgtgtagagtctataggtgggattggagtgataggaactccccttggattaattggcttctctgcttctttgtaggtggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405563 - DNA, 1540 bp, Homo sapiens
tgctgggattacaggcgtgagccacagcgcctgtccacccttggcattttgtatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405564 - DNA, 6136 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttgccgatgcgacaaggtttatatttctccctattactacgaccaaca

SEQ ID NO: 405565 - DNA, 4899 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcaggtatatgtggccaatagagccaagcaaaaatcttgctgggtgttaaagtattgtcaaattgaagcggagccaggaaatctgatgggaaactatcctttactccttcctctggacaaggctacttccccaagtgtctgtttttattttattaaatatcatgagattccacagttga

SEQ ID NO: 405566 - DNA, 3582 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405567 - DNA, 4216 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaaccgtgagtcacatttcttgatgctttttgagaaaggcaacatgataggtgaaaaaaactaatcaggaggatagggccctgctttgtcatctttctagagagagagagagagagagagagtgtgtgtgtgtgtgtgtgtgtgtgtgtgtgtgtgtctcagttttgctctgtttcccaggagaatggtgtgaacccgggaggcggagcttgcagtgagctgagatcgcgccattgcactctagcctgggcaactgaatgagactcagtctcaaaaaaaaaaaagagagaaaagaa

SEQ ID NO: 405568 - DNA, 2061 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagcacccctgccactttggaacagaactacatagtctgtgagctgcagcaaa

SEQ ID NO: 405569 - DNA, 2405 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacaggtaagaaactgctaccatgagatctaggaagtgacacagcttgactttctagtttctggaacttgagagatctgtttgattatgttactggaattaagaagtctaccttttcgtttttccagttgcgtttataagacattcccagcagttatgctttaccaggctttaaaatattggcatgtttgtgttagaagctgtatgctcccttttctacaaaatgtcctctgatagtcctggtctttttgggatttttagtatttaatgtgagaattgtcatgaggacattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttgaagatactgacccttctacctgcccagctgtttttaaacagctggagcgtgatgatggtcataaaatatataagtgttttagcatgtacagtaaaactaggttgtttagttaaacatagagttttgcctactttttcaattcgtttgactgcaggtgtggtcatttagttgcaaaccatttccatagtctgcttccactgtccagttaatctgttttttttttc

SEQ ID NO: 405570 - DNA, 596 bp, Homo sapiens
ggctgaggcaggagaattgtttgaatctgggaagcggaggttgcagtgagccgagattgtcccactgcactccagcctgggtgacagagtgagactgcctctcaaaaaaaaaagaagaaacataatggcatctagtaaaactgattaggagctaatgtattgttttatcaaattattccttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacaggtaaatgagagccaggctttattgtcacttgagtgctccatgagccccaggggagtcctttgctgcgtcctttcccttttatatgtccccagattgctgtaagtccatataaactaccaaatataacttaaagtagttgaatggaaagagcattagaactagaattagaagtctaaaaattattttaatcaactttaatgagtatagtttacatataataaagtatgcagtgtgataagttttatagtaactatcgcattgtaactacc

SEQ ID NO: 405571 - DNA, 224 bp, Homo sapiens
gaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtaagcacttgatatcatgttagattatactgaggagagacag

SEQ ID NO: 405572 - DNA, 3697 bp, Homo sapiens
ggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggc

SEQ ID NO: 405573 - DNA, 6965 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405574 - DNA, 6824 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405575 - DNA, 6656 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttgcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405576 - DNA, 6928 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405577 - DNA, 3292 bp, Homo sapiens
ctagaggatcccccaaagatgccatcgactggatttattttgaagagttttgccacttttgggattataaggaacaaatcacaggaaaagccagaatcagtaagctatataaagggcttgttgcattccactgtcactacacatttagcctggtagcttcctgttttcttttctttttattttttaaatagagatggggtctgtatgttgaccaggctggtctcaaactcctggcgtcaagcagccctcctgcctcagcctcccaaagtgctgggattagaggcgtgagccaccacatccagcctccgtctggtactatttatggtctttgtgcatttgtacagtgagaatttatctttgggattgatcttgtatgaacttattatgaatcattaaaaaaaggttatgctcaccaggacaccaacatgtagtaggagaggatcttaaggcatgccagagtcagattcttagggctgttgattcataaactccactttcttcctgtttattttgactgtaaggctaaacctctggtaaaggtactgccttttaggttactaaaagcttttgctttactactccccccctttttttttgttttttgttttgtttttgtttttgttttcgagacagtctcgctctgtaccccaggatggagtgcagtggcataatcttggctcactacaacgtttgcctcctgggttcaagcgattctcctgcctcagcctcctgagtagctgggattacaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 405578 - DNA, 5782 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttgcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttg

SEQ ID NO: 405579 - DNA, 6113 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttgaaaaaaaaatatataatacaaa

SEQ ID NO: 405580 - DNA, 4494 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggtggggaaggcatatggtccttctctgcgcctctgtcgccttcctactcactgcctcctaccgctccccgct

SEQ ID NO: 405581 - DNA, 2193 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaacacccctgccactttggaacagaactacatagtctgtgagctgcagcaaa

SEQ ID NO: 405582 - DNA, 2033 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagttgatagagaaaaacaacccagcgaaggcgccttctctgaaaacaatgctgagaatgagagcggcggagacaagccccccatcgatcccaataacccagcagccaactggcttcacgcgcgctccactcggaaaaagcggtgcccctatacaaaacaccagaccctggaactggagaaagagtttctgttcaacatgtacctcaccagggac

SEQ ID NO: 405583 - DNA, 1978 bp, Homo sapiens
agcggggcgaggggcgggactccacggcctctcaccgctcctaccctgtgcctccccgaactccttctgcccctcctcttccctctcgccccttcccccttcagttcggtttcaaaagacgcgtgcccaatgaataacagggtcgacccagagtggcggcgcgtcaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggtacatataaaaagcaggtttggctctcttaaagttacactgactataccacacgttattctcctgattcgtatgattggaaatatttaaaagttctcaggtaagcggtagcttgatgtgaagtaccagagggaaaggtttaaagtcctggatatggcttgagataattagtaggcatgtaaattgcctttcatttactttggattacttcagcaatagctgagaaaccataaaggaaacacatttggttaagtaacacattgtatgaggccaggtttcaaacctgtggtagcatacagaagataattggttattcttatttttgtcgttgttggtttgt

SEQ ID NO: 405584 - DNA, 442 bp, Homo sapiens
gacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactct

SEQ ID NO: 405585 - DNA, 242 bp, Homo sapiens
gcaatcctcctgccctggcaacccaaaatgctgggattacagatatgagccacagtgcccaacctatttatttatttatttatttatttatttatttatttatttaataaagaaaaggtctcactatgttgcccacgctggtcaattcctggactcaaatgattcttcaaacttggcctctcaaaatgttgggattacaggtatgagccaccatgcctggcctaaaaatagtattatatttt

SEQ ID NO: 405586 - DNA, 416 bp, Homo sapiens
gggtcacgtttgtaccctagggttgggtccatcaaatatggtttgaaagaatagatgaataaaacaatattaacaatagtaattaaccatttaattgatccttcgcaggcacccccaggccatgtgagagatgcaggattttttttgaatccccacagtcacctgtgagacagagaccgctcttacttccactcagcagagaagaggaagctctgagagctccttgcttacctctgccacccaggaaggaaccacggggctaaagggagaactcatctccgatagtgtcagaaagatgtgatcatcaaggcaaggcctgggtctctgttggtcatagttgaggccccagaagtggcctaggaacacagcactcaggaatgaatagctaccttttttttttttgagatggagtctgg

SEQ ID NO: 405587 - DNA, 787 bp, Homo sapiens
ccccggccatcagcctccggaacttcggccgcgtgcgaggcaccccccgccccccgcatctgctgcgcttccgggcggaggagggcggcgaccccgaggccgcagcccgcatcgaggaggaatcggcggagtccggggacgaggccctggagccctgaggtctcgcctgcccccgcccggtttcccccacccactgccctccttccctcccgtgcccggtcctgccagccagctctattagagcagcttttcctgtgtgccttgaaggccagagcatttagggacagaacttgaaagagaagatggcgaaaagggcctgagccagggctgggaatgtgtccactttggtgggagagaaggtcggttgcttgggggacgtgaagctagaaaaataaatgagcccaggcatagaggactagagcccaggtgcacggttagcttcacagcaacagggagctaggccattggttctcaaacttaaggaaggatcagcatcacggaaggtcttgtcaaaagagtgctgggcaccactcccagcatttctggcacgttagatttgggatggcgcccaataacttgcatttctaacaagttcccaggtgatgctgtgctgcttgtccaggaaacacaatttgagagtcatgtgaaacgtgcttgaaggggtataccttaccctggtaaccttactcaaaagaagggtcagtgtgtgctgggggacttttgccttgtttgtaatgttaaagtttttgtttacattgagaatatattcaagtttttgtttaagtgt

SEQ ID NO: 405588 - DNA, 482 bp, Homo sapiens
tttccttttttaatgcccctgctttgctacagccctcagcatgaacttattcttcctaccagataatccagcactgggtgagccttccaaactggtagtctgagccccatgtggaagagggaggagaagagaaagacagcggtatggtagaacatcccagactgccatgcagtctaagaaaggttctgcaaggccactgaagagtcttcaagccaaagtcggctgtcagaggagttctgtgtctcctagaatttccagactaagtatgtcttagtataacttcatactcagccagtcgctgagagaaaccacggaaggcatgggctcaatgcaaatacagcaatggatttcaaagtgcagctgggcccctaggtcaaccgcattctctgtaatcccccagtattggaggtctctgccacagatctctagtgtgataaaggggctcagtacccctgagaaaaagcttttctgactagtatctt

SEQ ID NO: 405589 - DNA, 496 bp, Homo sapiens
gaagaagtagagatagagagggatgttggtgatgttggatcctaatttcagttcctatctcaccacaggaccttggataatccagcactgggtgagccttccaaactggtagtctgagccccatgtggaagagggaggagaagagaaagacagcggtatggtagaacatcccagactgccatgcagtctaagaaaggttctgcaaggccactgaagagtcttcaagccaaagtcggctgtcagaggagttctgtgtctcctagaatttccagactaagtatgtcttagtataacttcatactcagccagtcgctgagagaaaccacggaaggcatgggctcaatgcaaatacagcaatggatttcaaagtgcagctgggcccctaggtcaaccgcattctctgtaatcccccagtattggaggtctctgccacagatctctagtgtgataaaggggctcagtacccctgagaaaaagcttttctgactagtatctt

SEQ ID NO: 405590 - DNA, 360 bp, Homo sapiens
atcttagtccatgtccatttgagctcttgagaaagcctccagtgctagtgccactcactctggtggcgcacttgcctgacttataatccttagccttgctgacgttccctagttatctcttcgctatctagtctgaagctggagggtagggtttttctgggtctcatttttcgtcagcagcactcaatacagatggtctccaacttctgcttcggtgtacgatttttctactttatgatggtgtgaaagtcatactcatttagggtactcctcaactcatgatgggattatatccagataaacccatcataagttggaactatttttttttttttttttttttgagacggagtctcactc

SEQ ID NO: 405591 - DNA, 4507 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagcta

SEQ ID NO: 405592 - DNA, 1432 bp, Homo sapiens
catctggaattgcaccatacttaaagacagtgtagtaatggataagactttaagtatggtgcaattccagatggttagttactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405593 - DNA, 1241 bp, Homo sapiens
  misc_feature (1162)..(1162): n is a, c, g, or t
aggttgaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctgtcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttgaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatatcacagacgatgaagcaacaagaacgttcatcgaagcctaaagatgcagtgggatttaagagcatctaaagcgaacgtccatctcgcaaaaatcattacacctggggacacaggcgacgattaaagtccggatcatagagcatcgtttttcaagcagggcgaagccaaagtaccatgccgagcatcgagtaaactgcctgataatgcgctgggttgaaagcctcctccaaaggtatcctaccgggcagaattgtcaagcaaattcaggaggttaccatcagtcaggacatgtagatggaaggtcaacatctcctgttgtctccctcctcctcccttgtcgtacatctnaagagagtccaccgtcgagacacaagcagcgacggagagggaaaaccgaacacagacaaaaaaataccaagacaaagga

SEQ ID NO: 405594 - DNA, 764 bp, Homo sapiens
aggttgaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctgtcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttggtgggtgtgtcgttcttctatcccaccctaggaactcccgaaaactgaagaccgccgggtcgcagaaggggagaagatggggcaggggcagaaaccctcttctttcctgaagtaaagattcgcaaaacttcagacattttcatccaggaagtaggaggccgcattaaaagaagtatttgtggaagatttcgcagcctcaagtgctgagtgtgatattatttgtaggcacatagatgctgtattaggctatcggaatttatatggaagatgtgtagaagatgatattttctgaaataactcgttaaatgttttgagtcctaaataaacctgctcagtttttcgttgggtaaaaataaaatctctattcat

SEQ ID NO: 405595 - DNA, 733 bp, Homo sapiens
aggttgaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctgtcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttggaactcccgaaaactgaagaccgccgggtcgcagaaggggagaagatggggcaggggcagaaaccctcttctttcctgaagtaaagattcgcaaaacttcagacattttcatccaggaagtaggaggccgcattaaaagaagtatttgtggaagatttcgcagcctcaagtgctgagtgtgatattatttgtaggcacatagatgctgtattaggctatcggaatttatatggaagatgtgtagaagatgatattttctgaaataactcgttaaatgttttgagtcctaaataaacctgctcagtttttcgttgggtaaaaataaaatctctattcat

SEQ ID NO: 405596 - DNA, 367 bp, Homo sapiens
ttctgtgtgtaatggttatggtaccctaggaataatcccaagaactgaataaagaaaaaaaggctgtcttaaaatgctaacaagatgctgtcatctttaggtcctctgagccagaatggctcttttggcccatcccctgtgagtggtggagaatgctcccctccattgacagtggagccacccgtgagacctctctctgctactctcaatcgaagagatatgcctagaagtgaatttggtgagcattcacatgtttccttgcaatactcttttgggtggctttttcccttttatttgagaattctaatgcaaacactttagaattcgggtctgtccagtatagaaaagaaaatttcttaatttgtct

SEQ ID NO: 405597 - DNA, 5086 bp, Homo sapiens
gacgtgttttataggcggcataaagcgaaagtgcaggcagctgtggaaggcgaagttcaatcccagagtccgccccctgaattggggcctttccggaggaggaagctctgaaaaacagggggcccagtgccattccgcagggaattgtcgcttgcgttcagctgttctacacaatggactcagtacctgccactgtgccttctatcgccgctaccccgggggacccggaacttgtgggacccttgtctgtgctctacgcagccttcatagccaagctgctggagctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405598 - DNA, 8524 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggtaaatgcacccattttgaataattagttatttcaggaacatttagctcttcctacaactctctctttgcctcatctcctatttgtgtgttctatctgtactatctcatttattttttaaaaaagcaaactgttctccaagagcctgaagtcccctcagttcccagcattacatctttggctgagcgtccagtagcagtaagtacttagaagtgtggactgaactgggctataagttgcatggcaatattgatcttacttttatccttgacttgggagtgttgctgaaatctgacggattcattggccttttctcctctctcctgtttggttagacatttaacctgtgtagagcatctgctgtaactgtaattaacttaaacaaaagtgaaaagtccccactcttgtgtgtctcagtgtttaatgctcttaggcaaagtaaattcattgtaaattgtgtaattcattattatgtcttcatttggaagtgtgctatttaagaatacctacagttgtatactaggcaaaccctattttgaatgatctgaaattacagattgataacagaagaatgtttgctggaagtgaaatactgaatagtggaagtctataattacccgttgagccagttcccagcagtgtccttaaacagtgtccacataagtgtattctcttgtaacttgtatagctgttatggctggtaagtcctctgatcatacctcactgtgattctcgacattgaaattaaaataattttaatgattgagagtttccaacccactttcccataggaagtgattaatcagtatctcatagtagacagtattactagtgaatgaagatgaatagagctgtgcctgtataatttgtgtacataacattgtttctcttggaaaatacttccaagttccagcacaggactccaggaatacacatttcttgagaaatgtttttatccaagagcagcttggataagacccgagacccctttgaagtaggagacttcgaagagtgtagagactactttgttagaaaggagaagcagaggtggaaagaacgtggccttggagtcaaacctggcatggaattccagccagcctcttacatgctgtgtgaccatcagcaaatctaatactctctgcgcctgtgttcctgcatatttagaacaagatggtcctattacagatttagagatgtcagaatttgtgttaatatatgtagggcctacagaaggtactctgaataatcgctgttacatggtagagaatggatttttcattccctttcattctctgcattcttaatatggaaattactctgataggagggatgtgcagagggagtgactgccttagaaatagatgtatgaatggcgtaacttctatcattagtcaggaatgacctccatttataacctgtgcgttcccttccatttgcagatgtaagcaataatatgatacagcaagtgttcactcctgtggcatacttttaacctttctaagcttgtcagtgggaacaaatgagaggggtagagttttttgcactaattctgctctttggacaagtgcctgacatctgcttcattgggttttagtttttactggtgttggtgcttttgtctgtcataccatagtatttcaaaacttcaattgtttctactctgcaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405599 - DNA, 6815 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405600 - DNA, 5997 bp, Homo sapiens
gcagtgagctcaagtgttgtgagtatccgcttaaaacaccgtgtgatgttaatctgcatgtgggcagttcatctctccagtaaattgtgtatcacagtaaacataatctctcatggttcttgtgtatttttcatgtttagtgcaataacataaaccttgaataacaccatgggacccatataaaatgccactagtgatgctggaagtattctcaagaagcaaagtcatgacactactagaaaaagttgaattgctttgatatataccatagtttggagtgtgcagcagcagtcatttcagtcagacgattcatcttgtaaacagaccatgtacacgtacagtacaaatacaatacagtgttataaatacatttcctcttccttatgatttcaataacattttctttagcttactttattaaagaatacagtatacaatatatatacagaatatgtgttaactgtttatgttattggtaaggcttctggtcaatagtaggctatttactagtaggtaggttttggggagtcaaaagttacacgtggatttttgactgcgcaggggatcagcacacctaacccctgcattgttcgagtcaactgtattataaaagtagccttaataactttatcgtttatgcggcatacatgtttccacttgtcattactatatagtatgaaacgctgttgagtctattttgaatcctaaatatgtctataatactcagtaagatacggaagtcagattacatatacactgaacaaaaatcaccatgtagaatactgtacatgtaagtctgtagcttgaagtatagaaccagagccattaatgtgcagggtttattgttctttcagtgcaaggcagttcttattttaattctttaagtccgtgcataaattgtaagtgatttcccttcataaatattgggagacccatttttaatgttgctttccagataagacttgaaccctgatctgtccacaatttattatttcttccaaaaaatacatataaggactctgttatttctttctcaaggatcagtggacgggcctctacctcatcctcgatggtcagctgaggcatctgggaaaccctctccttctggtaagggagcaagagtgttcaaagagtctaaaaccatgcaggaagtggggagaggattttttttttaatcctcctcacagagtacacaagtcagaataagtctacatcagttctctggtctttaacagatccaggatctggtacagctaccatgatgaacagcagctcaagaggctcttcccctaccagggtactcgatgaaggcaaggtaaatgcacccattttgaataattagttatttcaggaacatttagctcttcctacaactctctctttgcctcatctcctatttgtgtgttctatctgtactatctcatttattttttaaaaaagcaaactgttctccaagagcctgaagtcccctcagttcccagcattacatctttggctgagcgtccagtagcagtaagtacttagaagtgtggactgaactgggctataagttgcatggcaatattgatcttacttttatccttgacttgggagtgttgctgaaatctgacggattcattggccttttctcctctctcctgtttggttagacatttaacctgtgtagagcatctgctgtaactgtaattaacttaaacaaaagtgaaaagtccccactcttgtgtgtctcagtgtttaatgctcttaggcaaagtaaattcattgtaaattgtgtaattcattattatgtcttcatttggaagtgtgctatttaagaatacctacagttgtatactaggcaaaccctattttgaatgatctgaaattacagattgataacagaagaatgtttgctggaagtgaaatactgaatagtggaagtctataattacccgttgagccagttcccagcagtgtccttaaacagtgtccacataagtgtattctcttgtaacttgtatagctgttatggctggtaagtcctctgatcatacctcactgtgattctcgacattgaaattaaaataattttaatgattgagagtttccaacccactttcccataggaagtgattaatcagtatctcatagtagacagtattactagtgaatgaagatgaatagagctgtgcctgtataatttgtgtacataacattgtttctcttggaaaatacttccaagttccagcacaggactccaggaatacacatttcttgagaaatgtttttatccaagagcagcttggataagacccgagacccctttgaagtaggagacttcgaagagtgtagagactactttgttagaaaggagaagcagaggtggaaagaacgtggccttggagtcaaacctggcatggaattccagccagcctcttacatgctgtgtgaccatcagcaaatctaatactctctgcgcctgtgttcctgcatatttagaacaagatggtcctattacagatttagagatgtcagaatttgtgttaatatatgtagggcctacagaaggtactctgaataatcgctgttacatggtagagaatggatttttcattccctttcattctctgcattcttaatatggaaattactctgataggagggatgtgcagagggagtgactgccttagaaatagatgtatgaatggcgtaacttctatcattagtcaggaatgacctccatttataacctgtgcgttcccttccatttgcagatgtaagcaataatatgatacagcaagtgttcactcctgtggcatacttttaacctttctaagcttgtcagtgggaacaaatgagaggggtagagttttttgcactaattctgctctttggacaagtgcctgacatctgcttcattgggttttagtttttactggtgttggtgcttttgtctgtcataccatagtatttcaaaacttcaattgtttctactctgcaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405601 - DNA, 4829 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaata

SEQ ID NO: 405602 - DNA, 4879 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaataaaaaaaaaaaagaacatgccgtccgctgtatagtcatcctaggaggcgcg

SEQ ID NO: 405603 - DNA, 5565 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttgataaagatggcaggccaggcacagtggctcacgcctgtaatcccagcactttatgaatcccagcattcattagacgaggctgaggcaggtggatcccttgagcctaggagtttgagaccagcctgggcaacatggtgaaacccccatctctacaaaaaatccaaaaattagctgggagtggtggcgtgcacctgtagtcccagctactggggagtctgaggtgggaggattgattgagtccgggagattgaggctgcagtgagccatgatcactcattacactccagcccatgtgacaggcaagaccctgtctcagaaaaaaagaatttgctgttaggtcatgctgttttgtaatagtgattctctatgattagctggtaatttgctgatgatttatttaaagaaatggcattggaaccaacaaactcagtgtttttttgttaatgtttgcattttctataagtttgcacgttaaaacgtttaacaaactgtattaaaatcccagagagattatcagactgtcttttgctattataattgaatttaggatgaataaagtgagcttaattatagattcactttattgtgtttggttacagtaacaattgctcgagcaattgaactaaaacatgctcctggactaattgctgcactggcgtatgaaacagccaatttctatcaaaaagctgatcatactttatccagtttggagcctgcatattctgccaaatggagagaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactatatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtg

SEQ ID NO: 405604 - DNA, 3866 bp, Homo sapiens
  misc_feature (3778)..(3778): n is a, c, g, or t
  misc_feature (3802)..(3802): n is a, c, g, or t
  misc_feature (3858)..(3858): n is a, c, g, or t
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatcccaggatctgggnccagctacccatgatgaaccacanctcaaggaagcttctttccccttaccaagggtaccttcgatggaaaggccaagggnttaattat

SEQ ID NO: 405605 - DNA, 1971 bp, Homo sapiens
aacaggaagtgggcgctcagagctcgggggcggcgctcagttgtccaaccaaaatctagtactttgctattcaaaagtgtctggggaccagcagcatcagcatctcaggtcctgccccaggctattgaattagagcctgcattggacaaaaccacccacccccagaaaacatctggagaaaatgacccattggtttcataggaacccattaaaagccacagctcctgtgtcttttaattactatggtgtagtcactggcccttctgcttcaaaaatatgcaagcacctaccaaattctggatatacagcctctactctcttggtgcttaccatttaaatttagtctttctttaatggtttacacatatttcaagggtctttggtcatacccatgtattgtaatttcggaagcctcactaagctaattgccttctggattcgatttggaactggaatagaaccaagtgaaagctaatgatggagatctaggaattgatatagttgaagctatactaatagtgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagagaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactatatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtg

SEQ ID NO: 405606 - DNA, 1881 bp, Homo sapiens
aaaaccctcaaccctcaccttggaaatacaaagaagggagatatgaaagagaaggtagaatttaacagctatctaatgaatgctgctgaatttaattagatggagctggaaagccttttccagcagggcaagcaccttaatttttatggcatttattaggtacatcttgagctactgcataaatttttaactgatacacagtagttaatggaatttatcaaaatttttattgcaatgaagccatatttagtctgtcttcttggtatggtatatagtacttccaagtacaaatctatctctctttttcagataaagatggcaggccaggcacagtggctcacgcctgtaatcccagcactttatgaatcccagcattcattagacgaggctgaggcaggtggatcccttgagcctaggagtttgagaccagcctgggcaacatggtgaaacccccatctctacaaaaaatccaaaaattagctgggagtggtggcgtgcacctgtagtcccagctactggggagtctgaggtgggaggattgattgagtccgggagattgaggctgcagtgagccatgatcactcattacactccagcccatgtgacaggcaagaccctgtctcagaaaaaaagaatttgctgttaggtcatgctgttttgtaatagtgattctctatgattagctggtaatttgctgatgatttatttaaagaaatggcattggaaccaacaaactcagtgtttttttgttaatgtttgcattttctataagtttgcacgttaaaacgtttaacaaactgtattaaaatcccagagagattatcagactgtcttttgctattataattgaatttaggatgaataaagtgagcttaattatagattcactttattgtgtttggttacagtaacaattgctcgagcaattgaactaaaacatgctcctggactaattgctgcactggcgtatgaaacagccaatttctatcaaaaagctgatcatactttatccagtttggagcctgcatattctgccaaatggagagaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactatatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtg

SEQ ID NO: 405607 - DNA, 1021 bp, Homo sapiens
  misc_feature (979)..(979): n is a, c, g, or t
  misc_feature (985)..(986): n is a, c, g, or t
  misc_feature (990)..(990): n is a, c, g, or t
  misc_feature (1003)..(1003): n is a, c, g, or t
gacgtgttttataggcggcataaagcgaaagtgcaggcagctgtggaaggcgaagttcaatcccagagtccgccccctgaattggggcctttccggaggaggaagctctgaaaaacagggggcccagtgccattccgcagggaattgtcgcttgcgttcagctgttctacacaatggactcagtacctgccactgtgccttctatcgccgctaccccgggggacccggaacttgtgggacccttgtctgtgctctacgcagccttcatagccaagctgctggagctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaaaaagnggaaanntttnttttttttttttngggggggggggggggaaa

SEQ ID NO: 405608 - DNA, 1496 bp, Homo sapiens
ggttcttccacttaaaaggtataatggggtgtccttttatttttggaaattaaaggaattttactttccccaaaaaaaaaaaaaaaagaaattagccaggtgccatggcatgcatgtgtagtctcagccactcaggagactgaggcagcaggatcacttgagcctgagagtttgaggctgcagtaagccatgatcaagccactgcactccatcctgggtgacagcaagaccctgtctcagaaaaaaagaatttgctgttaggtcatgctgttttgtaatagtgattctctatgattagctggtaatttgctgatgatttatttaaagaaatggcattggaaccaacaaactcagtgtttttttgttaatgtttgcattttctataagtttgcacgttaaaacgtttaacaaactgtattaaaatcccagagagattatcagactgtcttttgctattataattgaatttaggatgaataaagtgagcttaattatagattcactttattgtgtttggttacagtaacaattgctcgagcaattgaactaaaacatgctcctggactaattgctgcactggcgtatgaaacagccaatttctatcaaaaagctgatcatactttatccagtttggagcctgcatattctgccaaatggagagaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactatatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtg

SEQ ID NO: 405609 - DNA, 2436 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcggtaagtttaacatagtttttttttaactaaaatgttgattattacagtttttaagttgattttgagcatgaggtgaagaacttaaaatgtctttatgaacctgactcctgatcctttgaagagagaccctgaaatgagccacaggtgtgtggctttaatgggctcttagttcagcacatgaggaggctttgctgcatgctggagctgggcacaagcacacctgtcaaacgtggttcttcctttcagggacctttcagtttagccaggagagaaagacagtcacttgaaatgtaacatgataatgggcaggaagagaagtatttacctgatggtagaacaatctgtggcataaattggttcatcgtggagggagagtgat

SEQ ID NO: 405610 - DNA, 546 bp, Homo sapiens
ggacatgttctaaaaagctctttcattggctgtctttatcatggtaccagccttggattgagaaacagcccataagaaaattaattagtggtctttccatggttagaaataagagaattatctcctgcatcatcctaataagcttaactgtgttaggttgatcagtcctggctttctacattgaagaaaagtgagcatcatttcaacccaacagtctttgacacatagtgttttttcacatttgtttcatttactagtgaggagagaattatgagacgttagaaaatgcaggtgatgtatcaacaggccacagttggatttttatcctaaaggacagttttatttccttcctgtgactttgtataatctatgcatttttaagaataggataggaagtgagattttattggagtattcagacagaatgccaggaggaaaagagaaacactttcattgacaaccagttttatcttaggaaactgagtcaagaagagtatgaacggcaagaaagagagcacaggctgtcagctgcagatgaaaaggcag

SEQ ID NO: 405611 - DNA, 653 bp, Homo sapiens
atggaggatgaattacagaagacagagcggtcatttaaaaaccaggtaataattctagtgccctactatatagtgcccggaattctttgataactaatagaggctattataatgaatctgtatgcatattttgtgatgtattatctttttcagatcgctacccatgagaagaaagctcatgaaaactgggtaagatttctttttttctttcccttattttgtgcatagtctcccacaactgaatttggatatttttcttcaatagctcaaagctcgtgctgcagaaagagctatagctgaagagaaaagggaagctgccaatttgagacacaagtatgtggattttgatggctatattttcagcgcgtgttctcttaaggaattggtttctatttcatatttaactctttcttaaatattctttctctatattcaagattattagaattaacacaaaagatggcaatgctgcaagaagaacctgtgattgtaaaaccaatgccaggaaaaccaaatacacaaaaccctccacggagaggtaagggagctaccttgtaaagggcaacaatctgttttttgatgtaaaatgtatataagtgactttttgtttctgtgtgtaatggttatggtaccctaggaataatcccaagaac

SEQ ID NO: 405612 - DNA, 426 bp, Homo sapiens
gaaaaacagggggcccagtgccattccgcagggaattgtcgcttgcgttcagctgttctacacaatggactcagtacctgccactgtgccttctatcgccgctaccccgggggacccggaacttgtgggacccttgtctgtgctctacgcagccttcatagccaagctgctggaggtgacagtcccgattcccggggagggacccaagctgtcacaggcgggtggatgagttctaagcagagtgggtgcactgattgtctgtgcaaaggagaaatggagtgtgtcagatccgaggaaagcaagacgtttctatgctgtttagggaggcaggtgggagtgtgtttgagaaggtttcgtcactcttttttttttttttattgagtacttacgaagtgacagcactttatgttctggtgtgaagtcatg

SEQ ID NO: 405613 - DNA, 6859 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405614 - DNA, 3884 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaaggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaata

SEQ ID NO: 405615 - DNA, 540 bp, Homo sapiens
aggttgaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctgtcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttggtaagtatgtcagaggatgggtgtttctcagtaatatcccccgctacttccccggagtctcaagcaataggatcacccccttttacattagtctccatagacccctggacagtggaccaaaagtctccttctagtgccttgaaac

SEQ ID NO: 405616 - DNA, 8652 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctggtaagggagcaagagtgttcaaagagtctaaaaccatgcaggaagtggggagaggattttttttttaatcctcctcacagagtacacaagtcagaataagtctacatcagttctctggtctttaacagatccaggatctggtacagctaccatgatgaacagcagctcaagaggctcttcccctaccagggtactcgatgaaggcaaggtaaatgcacccattttgaataattagttatttcaggaacatttagctcttcctacaactctctctttgcctcatctcctatttgtgtgttctatctgtactatctcatttattttttaaaaaagcaaactgttctccaagagcctgaagtcccctcagttcccagcattacatctttggctgagcgtccagtagcagtaagtacttagaagtgtggactgaactgggctataagttgcatggcaatattgatcttacttttatccttgacttgggagtgttgctgaaatctgacggattcattggccttttctcctctctcctgtttggttagacatttaacctgtgtagagcatctgctgtaactgtaattaacttaaacaaaagtgaaaagtccccactcttgtgtgtctcagtgtttaatgctcttaggcaaagtaaattcattgtaaattgtgtaattcattattatgtcttcatttggaagtgtgctatttaagaatacctacagttgtatactaggcaaaccctattttgaatgatctgaaattacagattgataacagaagaatgtttgctggaagtgaaatactgaatagtggaagtctataattacccgttgagccagttcccagcagtgtccttaaacagtgtccacataagtgtattctcttgtaacttgtatagctgttatggctggtaagtcctctgatcatacctcactgtgattctcgacattgaaattaaaataattttaatgattgagagtttccaacccactttcccataggaagtgattaatcagtatctcatagtagacagtattactagtgaatgaagatgaatagagctgtgcctgtataatttgtgtacataacattgtttctcttggaaaatacttccaagttccagcacaggactccaggaatacacatttcttgagaaatgtttttatccaagagcagcttggataagacccgagacccctttgaagtaggagacttcgaagagtgtagagactactttgttagaaaggagaagcagaggtggaaagaacgtggccttggagtcaaacctggcatggaattccagccagcctcttacatgctgtgtgaccatcagcaaatctaatactctctgcgcctgtgttcctgcatatttagaacaagatggtcctattacagatttagagatgtcagaatttgtgttaatatatgtagggcctacagaaggtactctgaataatcgctgttacatggtagagaatggatttttcattccctttcattctctgcattcttaatatggaaattactctgataggagggatgtgcagagggagtgactgccttagaaatagatgtatgaatggcgtaacttctatcattagtcaggaatgacctccatttataacctgtgcgttcccttccatttgcagatgtaagcaataatatgatacagcaagtgttcactcctgtggcatacttttaacctttctaagcttgtcagtgggaacaaatgagaggggtagagttttttgcactaattctgctctttggacaagtgcctgacatctgcttcattgggttttagtttttactggtgttggtgcttttgtctgtcataccatagtatttcaaaacttcaattgtttctactctgcaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405617 - DNA, 5065 bp, Homo sapiens
gacgtgttttataggcggcataaagcgaaagtgcaggcagctgtggaaggcgaagttcaatcccagagtccgccccctgaattggggcctttccggaggaggaagctctgaaaaacagggggcccagtgccattccgcagggaattgtcgcttgcgttcagctgttctacacaatggactcagtacctgccactgtgccttctatcgccgctaccccgggggacccggaacttgtgggacccttgtctgtgctctacgcagccttcatagccaagctgctggagctagttgctacattgcctgatgatgttcagcctgggcctgatttttatggactgccatggaaacctgtatttatcactgccttcttgggaattgcttcgtttgccattttcttatggagaactgtccttgttgtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405618 - DNA, 4875 bp, Homo sapiens
gcggccgcctactactactactaaatccgcggccgcgtcgattttttttttaatcctcctcacagagtacacaagtcagaataagtctacatcagttctctggtctttaacagatccaggatctggtacagctaccatgatgaacagcagctcaagaggctcttcccctaccagggtactcgatgaaggcaaggtaaatgcacccattttgaataattagttatttcaggaacatttagctcttcctacaactctctctttgcctcatctcctatttgtgtgttctatctgtactatctcatttattttttaaaaaagcaaactgttctccaagagcctgaagtcccctcagttcccagcattacatctttggctgagcgtccagtagcagtaagtacttagaagtgtggactgaactgggctataagttgcatggcaatattgatcttacttttatccttgacttgggagtgttgctgaaatctgacggattcattggccttttctcctctctcctgtttggttagacatttaacctgtgtagagcatctgctgtaactgtaattaacttaaacaaaagtgaaaagtccccactcttgtgtgtctcagtgtttaatgctcttaggcaaagtaaattcattgtaaattgtgtaattcattattatgtcttcatttggaagtgtgctatttaagaatacctacagttgtatactaggcaaaccctattttgaatgatctgaaattacagattgataacagaagaatgtttgctggaagtgaaatactgaatagtggaagtctataattacccgttgagccagttcccagcagtgtccttaaacagtgtccacataagtgtattctcttgtaacttgtatagctgttatggctggtaagtcctctgatcatacctcactgtgattctcgacattgaaattaaaataattttaatgattgagagtttccaacccactttcccataggaagtgattaatcagtatctcatagtagacagtattactagtgaatgaagatgaatagagctgtgcctgtataatttgtgtacataacattgtttctcttggaaaatacttccaagttccagcacaggactccaggaatacacatttcttgagaaatgtttttatccaagagcagcttggataagacccgagacccctttgaagtaggagacttcgaagagtgtagagactactttgttagaaaggagaagcagaggtggaaagaacgtggccttggagtcaaacctggcatggaattccagccagcctcttacatgctgtgtgaccatcagcaaatctaatactctctgcgcctgtgttcctgcatatttagaacaagatggtcctattacagatttagagatgtcagaatttgtgttaatatatgtagggcctacagaaggtactctgaataatcgctgttacatggtagagaatggatttttcattccctttcattctctgcattcttaatatggaaattactctgataggagggatgtgcagagggagtgactgccttagaaatagatgtatgaatggcgtaacttctatcattagtcaggaatgacctccatttataacctgtgcgttcccttccatttgcagatgtaagcaataatatgatacagcaagtgttcactcctgtggcatacttttaacctttctaagcttgtcagtgggaacaaatgagaggggtagagttttttgcactaattctgctctttggacaagtgcctgacatctgcttcattgggttttagtttttactggtgttggtgcttttgtctgtcataccatagtatttcaaaacttcaattgtttctactctgcaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccgtaaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatggggggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtgttcaatttaagcttctttaatgttgatgaaaggtatttgtagttcatataaactatacttatgtgaaggatagcagatgcttcatataaattatcattttgatatacatatcttatggtttatgagaaaagagaaaaaataatacatcggttttgctac

SEQ ID NO: 405619 - DNA, 5079 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactaaaaaaaaaaaaaaaaaaagaaaaaaaaaaaaaaaaaaaaaaaaaaaaactcaagggggggcccaggacccaattcgccctatagagagtcgccttacgggggactgggggccctattacaccttatggagtgggaaatccatggcgttgcccaactttttccactgtgggaacttgaaaatctcggcggttggccaattaacgaggagtgccgcaaataccgtttttcccaacgggggaaacacccaaaagcccaatggcaaatcggttccgaaataattgggacacaattggggtaaagccaatttt

SEQ ID NO: 405620 - DNA, 5184 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctggtaagggagcaagagtgttcaaagagtctaaaaccatgcaggaagtggggagaggattttttttttaatcctcctcacagagtacacaagtcagaataagtctacatcagttctctggtctttaacagatccaggatctggtacagctaccatgatgaacagcagctcaagaggctcttcccctaccagggtactcgatgaaggcaaggtaaatgcacccattttgaataattagttatttcaggaacatttagctcttcctacaactctctctttgcctcatctcctatttgtgtgttctatctgtactatctcatttattttttaaaaaagcaaactgttctccaagagcctgaagtcccctcagttcccagcattacatctttggctgagcgtccagtagcagtaagtacttagaagtgtggactgaactgggctataagttgcatggcaatattgatcttacttttatccttgacttgggagtgttgctgaaatctgacggattcattggccttttctcctctctcctgtttggttagacatttaacctgtgtagagcatctgctgtaactgtaattaacttaaacaaaagtgaaaagtccccactcttgtgtgtctcagtgtttaatgctcttaggcaaagtaaattcattgtaaattgtgtaattcattattatgtcttcatttggaagtgtgctatttaagaatacctacagttgtatactaggcaaaccctattttgaatgatctgaaattacagattgataacagaagaatgtttgctggaagtgaaatactgaatagtggaagtctataattacccgttgagccagttcccagcagtgtccttaaacagtgtccacataagtgtattctcttgtaacttgtatagctgttatggctggtaagtcctctgatcatacctcactgtgattctcgacattgaaattaaaataattttaatgattgagagtttccaacccactttcccataggaagtgattaatcagtatctcatagtagacagtattactagtgaatgaagatgaatagagctgtgcctgtataatttgtgtacataacattgtttctcttggaaaatacttccaagttccagcacaggactccaggaatacacatttcttgagaaatgtttttatccaagagcagcttggataagacccgagacccctttgaagtaggagacttcgaagagtgtagagactactttgttagaaaggagaagcagaggtggaaagaacgtggccttggagtcaaacctggcatggaattccagccagcctcttacatgctgtgtgaccatcagcaaatctaatactctctaaatctgtaataggaccatcttgttctaaatatgccaggaacacaggcgcagagagtattagatttagagatgtc

SEQ ID NO: 405621 - DNA, 1964 bp, Homo sapiens
aggttgaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctgtcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttgaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagagaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactatatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtg

SEQ ID NO: 405622 - DNA, 1292 bp, Homo sapiens
caaaaacagcatcctgctgggcacttggaacctgtccttgcaatgtatcagtccacttgaaattttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagagaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactatatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtg

SEQ ID NO: 405623 - DNA, 2424 bp, Homo sapiens
ccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagtgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgggaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacactttcatccagaggacactttgcatccagag

SEQ ID NO: 405624 - DNA, 314 bp, Homo sapiens
aataagtctcaagcactgcttcggatggttttagaaagggcagttcccctgaacactctattgcctgccatcatgtcagacatgactttgagcctattcacctccaccatgattgtgagacctccccaggcatgtggaattgtgagtccattaaacctttcctttataagttacccagtctcaggtatgtctttattagcagtgtgagaacggattaatacagtaataaggctggcatttcctttatatgtgtgtgtgagcatatatataaaaagaggtattctccagtctttctcctttctcccattttacct

SEQ ID NO: 405625 - DNA, 217 bp, Homo sapiens
cttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtaca

SEQ ID NO: 405626 - DNA, 409 bp, Homo sapiens
ggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcagctctagtgctggaaagccctggggaggcagaaggaagggccagatttggaagcatgcagacagcctttcccccaagaatgagactctccaccacctggaaacaacttgccgagggccaagacggagttttgttcttgttgcccaggctggagtacagtggcgcggtcttggctcagtgcaacctccacctcctgagttcaagcaattctcctgcctcagcctcccaagtagttggaattaaaggcacccgccac

SEQ ID NO: 405627 - DNA, 213 bp, Homo sapiens
gcggccgcctactactactatacggctgtttagaagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 405628 - DNA, 414 bp, Homo sapiens
ctccagggacccggtccaaatttcccgggtcacaacatactaataaattcgcggccgcgtcgcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 405629 - DNA, 465 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggctcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 405630 - DNA, 1660 bp, Homo sapiens
  misc_feature (41)..(41): n is a, c, g, or t
ctactactactactaaattcgcggccctcgacttttttttntcagttctctagtatctttattatccattccctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 405631 - DNA, 511 bp, Homo sapiens
  misc_feature (41)..(41): n is a, c, g, or t
ctactactactactaaattcgcggccctcgacttttttttntcagttctctagtatctttattatccattccgggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 405632 - DNA, 2059 bp, Homo sapiens
  misc_feature (1908)..(1908): n is a, c, g, or t
  misc_feature (1911)..(1911): n is a, c, g, or t
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactgaaaaaaaaaaaaanaanaaaacaaatacacaacaagggggggcgcaaaaaaactcccgagggggcccagattaacggacacagctttttcacaagggcccaagagggggatatacagagaagcgccgcggtaaaacggcgggggaaacgggcgggcttgtgaaga

SEQ ID NO: 405633 - DNA, 1895 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 405634 - DNA, 1402 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcaggtgagccctctccatgtgcctgcttccgtaagatgggtcacaggcaaggctgaggtcgctggggtgggtcggggcactgctggatggactctggccacctctggcccagcctcgggcagctttggggatgctggcacttctacacacagtcagctgtgagcctgggccaggaaggtttctgtccacctctagtgtcccaaccatgccagcctagggtccccactggtaggtgctggatgatatgaattcaagctctgtgtcccccacctcctcttggacttcgctctcccctcattcactctgctcccgccacactggcctgtttgctgttcccacaacatttgctacgctgctgcttcttcagcctagagcgctcttcccccaaatatctgtgtgactcacttccttcaggtcttggctcagatggcaccatccgcatgaggccttccctgacccctccattaaaattgctgcccatgagcacaggacatggtaaagaaaacaaacaaaaaaatgaaaaataaaagaaagaagaaaaatttctgctcaca

SEQ ID NO: 405635 - DNA, 492 bp, Homo sapiens
tgtaatcccagcagtttgggaggctgaggcgggcggatcacctgaggtcaggtgttcgagaccagcctgaccaacatggtgaaaccccatctctactaaaaatacaaaagttagccagacatggtggcaggtgcctgtaatcccagctacttgggaggctgaagcaggagaatcgctggaacttgggaggtggaggttgtagtgagcagagatcacgccattgcactccagcctgggcgacaagagcaaaacttcatctcaaaacaaacaaacaaaaaggtagaggaagggagaattatctctctgcctgactgcttgagaggtggcaccttctcctgtcctccagctgggacttgaacccacagccccactcatgtgcaggccttcaactcaaactggaaccacaacaccggctctcctgggtctctggcttgcagatggcagatcgtgaggcttttcagcttccaaaatcatgtgagccaactcctcaga

SEQ ID NO: 405636 - DNA, 663 bp, Homo sapiens
gagcagcctaccgaggctgaagggcaggcaacaaatggaaaaggaaggaaaaatacaaacccgccctttcctccctcttgtgaacctgttcaaagcacttgcctcgcccgcccgtgaggaaacaggtgctgagtgctcctggggaagccaaactttctcccggtttcccctgggccactttcccactccccagggacagtagcagagcttccagctgaaggcagctgccaccttcccccatggccccccacctttaggactcaacagccccacccattcaccagctagggaacatggagtcatagcagtcctgtttattgagtacctaatctgccagacatcgggctgaatgccttccttccagccattcaagaaacatatatagagcacctaccgtgtgcaaggcagcggggacacagcaccgaacaaaatagataaaaattccttgtcctaatggagtttacatgctggcatgggcaaaaccccttaaacaagataaataagtaaaatgcatagtgtatcggggcgatgcatgctgaggggcagtggaagcatggaagggagactgggtgctggggaaagggaaatgctgacacttcaataaaaatttgaggttcggccgggcgcgcagtagctcacgcctgtaatcccagcactttgaga

SEQ ID NO: 405637 - DNA, 697 bp, Homo sapiens
gacttttcaaatgttgactcaaccttccgtttctggaataaaactactttgctcatgatattggtcatatggatagatatttctggtcttggtttgctattttttaaagacaattttgcatctgtagttgtaatttttctagattttgcatctcattttccttgtaattttttcagtgacctgtaattttattttcttgtaatgccctgcaacttattgttattgataaccaccacccctttactaataaagaagctataattcaggaagaagataggtcccatgcaacccgttagtttccatctatccaccagagaacgttagtttgtcgagggaaacactggctgatggatccagtagtaggaaaacataatagacattcaggttttggtaaccaaagttgtgctaatcttgtagagtgagtaggagaatgttcctgcctattcttttcttggaagggtgtgtataagattgttaatagccatcaccgccactcatctctagagcttttcatttttctcaactgaaactatgcatctattaaacaccaattttccctagcacctggcaactaccattctactttctgtgtctgaatttgactactccaggtacttcatatacatggaaccatacagtatttatccttttgggattggcttatttcacttagcatgtcttcaaggttcatccatgt

SEQ ID NO: 405638 - DNA, 254 bp, Homo sapiens
tacattcctaggccgttttacattcaaaataccaaaccctaactaattccttaaagctagatcccaaatccaattcctgaccctcatttgccaacacaaattaaaaaaaaaaaaatcaagacagatggacagatgacaaacaagtatatgaaaagatgatccacatcacacgtcatcagggaaatgcaaactgaaatgatgatactaatacacacctgttggaatggccaaaatctagaacactgacaacacca

SEQ ID NO: 405639 - DNA, 271 bp, Homo sapiens
cgccactgcactccagcctgggcaacaagagtgaaactatgtctcaaagaaaaagcaattttataggtctcatcccagaatcaaaaatgctggagtaattaacaagacctctagatgattctgatgaacccctactccacgttatgaattaagtacttgagcctagggcctttatttaagggttgtccttctcttgcgtagctcttttaaagtgtccagtattctgaagttaggagccaagtgtggtaaagatgtttcttttgggaagaaa

SEQ ID NO: 405640 - DNA, 361 bp, Homo sapiens
gcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagc

SEQ ID NO: 405641 - DNA, 329 bp, Homo sapiens
tctcaggcagttccctagaaactgtagattttcctcataggaaaaaaaaagctaatataagcttagtggtttatattttttttcctttgcttttaaaggtaaaaccagtaatccatagcaggatcaacgtgtcagctcgctttagaaaaccgcttcaggagccgtgcactatcttgtaagttgaaaccctttatacttcaagttaaaattggcttggtggtttccttttggtttggaatttgtgttgtagttttcaaggcataactgtttcagaaggtttgcctcctgttttccagcttgattgcaaatggagacctcataaacccagc

SEQ ID NO: 405642 - DNA, 340 bp, Homo sapiens
gcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagagctacatgttctctgattgaaatccatgggaaggttccctgtcaagtgagaagattctgagcgttgttaaataaatctttaccaaagcta

SEQ ID NO: 405643 - DNA, 800 bp, Homo sapiens
cgctcctccgggcagagcgcgtgtggcggccgagcacatgggcccgcgggccgggcgggctcggggcggcgggacgaggaggggcgacgacgagctgcgagcaaagatgtgccccgggacccccggcaccttccagtggatttccttgcggaaaggatgtggcggtccctgtgacctgtggagacacggcagatctgccctccacagatggagaaaagaagattacccttcccaatgtgggtggaagtaacctagtcaactgaaggccagaccagaacttacatcattggctctcctgagtctccagcttgccggctgctaatcttgggatttctccatgtcatgccctatctccaaatacagtcacattctgggaccgcagattatgaacacaggaatgttttgacactggagactgtggagggaactcagcccagggtctgattggtgtcaggctctgtacatggacactgtggtggaggtaattacctgcagctctaggagcacccagagaacaaagtcattaactcattaggccagaaggagactaggaagactccacagagaaggctataaggaaacattgcacaggagcggcagggcaggaagcgtgctttatgaagatttacccggcagcaggtgtgaaattggcagaagagacaggaggatgacgctgagaagtgaagggcttgaggcataaaacagttaacaaactgttgaagctgtcttggggagaggtaattaattctgctcagctgttagttggtgttctgactgtacacatttagaatgatgggctt

SEQ ID NO: 405644 - DNA, 591 bp, Homo sapiens
gcggccgctccgccctcacctgagcctgaggttggccatgaactcgggcatggagacggtgtccatcagcacgaagtctgccttgccgaattccaggctctcctgctccgccatggcgccagcgcgggggctcaggattattgcggatgtcttgagcatgggaccattctttttgcatccaccaaataactattgtactactttgcatatataaatatgaaatccatactggttcagtggaatgaagtgagttgacatcttctattacaaaatctacgaggaaatctagaggcctccaaggacctggctgggcttcaactctggctgagtttgagatgagtaaaccagactgaaggaccttgcccaaggcctgcttcagctgccagccacccacacttgctaagagaaaggaaaggagctttgtcacctcctgagggactgcctctgccatcagaaaaccaccccaatccctggcaccagcagagctgggttgcatctgactaccgttagcagctgtccttcagaaggaggagatccacctgtctcgatatcagtgtcctcatttgtggaataaaagctctggaataaggt

SEQ ID NO: 405645 - DNA, 175 bp, Homo sapiens
ctcccaggcgcttgtagggggaagaggggatggcaaaggggattaagagcctggaaaaagccaacggcatgggccagggaagttccacagggaagggcctttccggggtttggggtagaacagtttagaaatgtgtgagcaagaggaaggctctgtgaggccaacaacaggctgg

SEQ ID NO: 405646 - DNA, 562 bp, Homo sapiens
aactaggggtaaagttatcagtagcacatgtattataagctaacttgataattcttacgttgtttatcatgtaatctgtgttttgatagtgatgaagaatattcattgcacttcattaagagagaatatttttgtttctcttcaataattgttcaaaaaaatttgaggcaagttttgcttcttataatggtgagaaaacttttttagactaactatacccctcctcactgagaggtgaagccagacttctgggccgggtggggacttagagaacttttctgtcttacaagaggattgtaaaatgcaccaatcagcactctgtagctaggattgtaaaatgcatcaatcagtgctctgtggctaactagaggtttgtaaagtacgccagtcagtgctctgtaaaaacgcaccaatcagtgctctatggctagctagaggtttgtaaaatggaccaatcagcactctgtaaaatggaccaatcagcgctctgtaaaatggaccaatcagtgctctgtaaaatggaccaatcagcaggacatggtggagacaaataagagaataa

SEQ ID NO: 405647 - DNA, 172 bp, Homo sapiens
acaccaaacactggccatggcaggacgttcctataagcacatattagggtgacatatcatacttgagggctttagtgccatatctgtaagatccattagaagtcaacaggaaaataacatgaaatccaaaaactgctttattttcaacaaagcaacaaacgagccagtagtg

SEQ ID NO: 405648 - DNA, 378 bp, Homo sapiens
gaagggaagggaagagaagagagaagaagaaagggaaaagaggggaggggagggaagaaagaggctgggcacggtggctcacgactgtgatcctagcactttaggaggctgaggcaggaggattgcttgagaccaagagttgaagaccaacctggccaacttaacaagaccccatctctataaaaaaacaaagagaggtagggaggaagaaaaattgggcattcattcaacaaacatttactaagtgcctactgctgtgctgagcgctattttaagtgctgggatacagaagcaaacaagacaaaatccttgctctggaagagctgacattccagaggacagcccacccgagcaaaatggaggaagagtcaggagctg

SEQ ID NO: 405649 - DNA, 418 bp, Homo sapiens
ggggagcaaaataacattccataaagagctgggcttagacaggtgcattggctcaacatctgtaatcccagcactttgggaggcagaagtggaaggatcacttgaggcctggagtttgaaaccagcctaggaaacatagtgagaccgtatctttaaaaaaatttttaaagttagccaggcatggtggtgtgtgcctgtagtcctagctactcaggaggctgaggtgggaggattgcttgagcccaggagttcaaggctgcagtgagctaggatcgtgccactgcactctaccctgggcaacagacctagaccctgtctcttatataaacaaaagagctgggcttaactgtgaacaatgtgtttagaactctggagagttgcagttctagctttccttgtctttttttcttattcactc

SEQ ID NO: 405650 - DNA, 282 bp, Homo sapiens
tctagttgatagaaagtttctctgctgaggtggaatctggcttcccctgcaatccctgtactttggttcttagttttggcttgtgaagtaacacagaatatgtgtcttgtctatagcaggttgctaagtaaatgaagacagccctccatcttctttcatttccagtgtcccttcattcctcgacacccagcctgctctcttgatgtattcttccaattttcatatatggaggagatcacatctaaaaggtgttactaacaaaagaatctggctaggtgctgt

SEQ ID NO: 405651 - DNA, 251 bp, Homo sapiens
ggaatacaccgaaaaaaggacccctcctccccagaacttgggatagtattgttataagtctttttgttatgttatagtttttatgtcttggacttaaaaaaaaaataggtctcttgagtaaagaatatacaagtgaaccatgaggttgatcagcactgactaacgaggtgtggctcagtccttgcagtcccacagctgcctgtggtcctacctggagccgctttgtgtgcattggtccccccttgaggtct

SEQ ID NO: 405652 - DNA, 447 bp, Homo sapiens
caaaattcatggatgctcaagtctcttatatagggtgatgtagtatttgcatataaacctatgcctatcctactatatactttaaataatctctatattactcataattcctaatacaatttaaatactatgaaaataattgttacactgtattgtttagggaataattacaagaaaaaaaaagtctgtacatgttcagtacagatgcaactgtcataagcctaactatattttcaatctgcagttgattgaatccacagaggaggaacttacagatacagggggctgactgtatatacacacatacacagatatttaatatagaagaatttcttttttaaccccaaagctagtattaagttggtgttatgacttgtagtgtcttagttcatacattcttactctaaaaggagtctgtacaaagtttagtgggaggattatggaaga

SEQ ID NO: 405653 - DNA, 134 bp, Homo sapiens
aaccattgtgctagaaagtgaggaaaggggccaggcacatgggccctatataggtctgcatccctgacaagtccagtctggttttccacactgaacttcaaggaaagaaaaatgtttttagagtcactcgattt

SEQ ID NO: 405654 - DNA, 363 bp, Homo sapiens
cccatccccggagcaaggataacccactcctcctgctcaaagggtcaggactgttgatttaaaaggaaaagaacaaaaagaccatcccaggcgtggagaggtcagaccctcacgagggcaaaggggatgtcaaacggcgcggctgctgtggaaagcagcctggggttcctccacggttccatgtggagttaccgccccagcaattccacttctgggcgtgcacccgaggggatggaaaacaggtgtccaaacaaaaacaagcacacgaacacacagggcagcaccatttctagtggcctgaaacaggaacagcccccacgctcgccgctgatgaatggatacacaccatgtggtgggtctgct

SEQ ID NO: 405655 - DNA, 341 bp, Homo sapiens
attaattcttacttctcagcatcaagtatctagatgaatcttaccaattctccttttactctgttgcctggcattgattctactttaattggaactccatctttgccttctcgataagttagcttgctttctcattcctttttttctttctttcttttttgtgtcttcctcaaacttacccttaccctgctatctcttcctgtgtgattatttcactctgaagttttgtcacagttttttttttttactgcagcttccaaggtcatttgaaatttgtgtgttcatggtaattaccactctgctataatgttggagtaaaggcaaaaattgtcattcattct

SEQ ID NO: 405656 - DNA, 2062 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405657 - DNA, 2379 bp, Homo sapiens
ctcttaggatagtttctgctttctagtgttcctgtctttgggtcctcacctctgcatggttactaacgggttatccgagcctaagcctctcacgaagcggaaagtcaagttaacagactgccataggcctgccaagtcagaatagggcttccgaagcagaatgtttgagccaataggaattgtttggaaaacggggataaatctaaaggatgggtaggatttaagtggtaagggaggataaagaggctataactgttctgacataggtgtggaagcaagaagaaagctgtacctagaaaaagagcgacgtttgtttggctgagaaataatctgtttaaaggataatgagaaagatgcgtggaaaaccccagcagcggagtgagaccctgtcaaaaaaaaaagaaagaaagaaaatagaagccaagaatggagacccaaatgactgttcagagtttcttcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405658 - DNA, 2008 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttatttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405659 - DNA, 2142 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaagatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405660 - DNA, 2008 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405661 - DNA, 1916 bp, Homo sapiens
gggaacggggcctgtgcgcacgcgcatctgacggttgtctcggttactcattgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405662 - DNA, 1597 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405663 - DNA, 1527 bp, Homo sapiens
gacggctggggagctcccagccaactctgtgtctgggtttttcaagaggatggtgaagtcggaggccagcaatgcggctaccgcctatttccgtccagcaagacccttgccctctctggtcacagtcctggggctgggctacttcgcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttacccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405664 - DNA, 1062 bp, Homo sapiens
gggaacggggcctgtgcgcacgcgcatctgacggttgtctcggttactcattgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgcttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405665 - DNA, 856 bp, Homo sapiens
ctcttaggatagtttctgctttctagtgttcctgtctttgggtcctcacctctgcatggttactaacgggttatccgagcctaagcctctcacgaagcggaaagtcaagttaacagactgccataggcctgccaagtcagaatagggcttccgaagcagaatgtttgagccaataggaattgtttggaaaacggggataaatctaaaggatgggtaggatttaagtggtaagggaggataaagaggctataactgttctgacataggtgtggaagcaagaagaaagctgtacctagaaaaagagcgacgtttgtttggctgagaaataatctgtttaaaggataatgagaaagatgcgtggaaaaccccagcagcggagtgagaccctgtcaaaaaaaaaagaaagaaagaaaatagaagccaagaatggagacccaaatgactgttcagagtttcttcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaaggtatgtgaatgagaacaagttatgatgaccccaggaaaacccttctccgggttacctagccaccaactgtgacccttctgaaggaggaggaaacaagcactgctgttcagtgagcctgctcttccaagatggcaactcatctttatttttctttactaaatatcatacacatttacaggatcatataaatttactttccaaaac

SEQ ID NO: 405666 - DNA, 393 bp, Homo sapiens
gggaacggggcctgtgcgcacgcgcatctgacggttgtctcggttactcattgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaaggtatgtgaatgagaacaagttatgatgaccccagggaaacaagcactgctgttcagtgagcctgctcttccaagatggcaactcatctttatttttctttactaaatatcatacacatttacaggatcatataaatttactttccaaaac

SEQ ID NO: 405667 - DNA, 2114 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaaatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405668 - DNA, 2098 bp, Homo sapiens
gcgcgacacttattgcatacaaggactctgctcactagttacatcagccatgcccacgccagtacccagttgcacaacatggtttgatttttgtccatcaagtactgcttatacagaacctggggcccctggtccccgttcacgcattacctggtgcaccaacatcacacctgtctctgttcaccggggtcttgggcttgacctggtcgtattccatgatgggacagtcccgctgtgccattagtatcgcggcacgcacgttgacgcctgcaatacggattaccgatagataactgattctgcgagacttctgatttgattttgccccggtgttatactctttcctctgtgttaaaaacagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405669 - DNA, 2371 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaatgcttttcttgtatttgtcagttttaacatattgatgcacatttgatactttttctcaaatagactactagggaactgtttatacacttcagatatcagtttgtttttcactgataaagaaatgcaaaacactgtggttgtcgggtatatacgtactatattttagaactgtccatgtcccacttacctcctccacatacaaggaatcactagggtggacctgagtgtctccttttcattgtaggattgtctcctttttgtttctgtttttattcaacatttgataaagtctatgcactaagt

SEQ ID NO: 405670 - DNA, 1522 bp, Homo sapiens
tccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttacccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctagtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctcta

SEQ ID NO: 405671 - DNA, 434 bp, Homo sapiens
agtaagctgaattataagttttaaaagttgcatcataatttctctaaaatctcttataattacttgaaagcaaaatacaaagaattaagtattatgagtgattgtctataatactcatgaaatggaacaagaatctttacaaagtattttccagtaattaagtaactctcttaatggcctatacctatattttgggctctctaatatcatgggaaacaattttcagtaaagattatcattacttatattctacttactgcagttaatttcctggttaaaatagtttataaagagcaaatttttccttttaaagaaagacaggaaagctacatgtagtggtgcttggctctatagccccagctactggggaggatcgcttgagcccaggagttcaagttcagcccagccaacattgttagaccccatctctgggg

SEQ ID NO: 405672 - DNA, 778 bp, Homo sapiens
ttttttaaaatgtaaatggagtaaatgataaaatgtagactgaatttatcataaagacattttcttttggtatactgcaaggaactatgaacttttagtaactactataagcaactgacaggaaaaaatggcaacagaagaaggaaagaggagagaatggggagcagacactaaggtgtagtgaaaggaggaaaatgaaggctaagtctaatgatgtgaatcctctttgcaattccatcaaaggagggatcttcctactgaccagaagacctgaacagcctgagaatgattcctttcaactccgagagaagaagctgcagatgaagagcaatcctgggatacatgtgcagaatgtgcagaatgtgtacataggtacacactaccatggtggtttgctgcacccatcaactcgtcatctacattaggatactgtttactgaaaacccaccaatctgatcttttatgagaagctagtccctgaaaaggcccttggatcaaaggtcaaaaacttgaagcacagagtgggatgtcagatgccaagatttaaatctagtcatttgattccagagcccacattcttaaataatatgctacactgacctttattgtctttaaacattatctttatttaatgtgtttcatagaaattacttctcaggtattcctaaatttatttttaaaaataatgtcatgctatcactataatatagttttttaaattaacttgagaggtaatgtagtatgatcaacttccttaatggccttttaaactggaaat

SEQ ID NO: 405673 - DNA, 499 bp, Homo sapiens
gttaggttgccacatgtgtactgaggaattgctgaaggttttcaaatagggtggaggaagtttcatgataataggttatttgaatatgtttttccagtttgagacatttccaagatgttgaggcatcaacaataagcatatttcattaaaaatctcagagggagcattctgttctgctgtggccccagccatggtctctgggttctcattttggcattttcccttggataaatgttatctcagtttatttatagctcatttagcccatcaaagcaataataataatccccaaaatagagagagatgctctgatgatcaataggttacataaaaaacatttttgcgcagagtgaaagtcaagagggtgctattattaatacaacctcccacaaccaccctctcattctctgcatctacccagtttgtgttatttccttcaagacctttcctcaagtatttttcctctctgaagccattcctgactcaatctaccacatct

SEQ ID NO: 405674 - DNA, 391 bp, Homo sapiens
gggtgtgggtagaggaaactaggtattcaggttcattttaacattctttaaaactgtagaggttatagtgaatgtataatatatttagcaaaaatattaaaacacagctattggttcacactacacatgggttataaggtgtattaaatagaacatggacataagcagttatattgagacttacgcaggagtttttagttttcaaatataatactaatggaatggaaatgaacacttacgtactcaccacacagattaagaaaagtaatatgattactaatacttttgttaagtctctgtgtgccccttcatgattgcattggtggtttatactacatgagatgactgctgtctacacaaagatcttttcgtttggcagtgtgtttttgaa

SEQ ID NO: 405675 - DNA, 918 bp, Homo sapiens
tagtttgtaagattttaatttacaaattaaaaaagctatttaatacatgttttactttttctcctttttctcctctttctttacatcactcttttccttatctttatctttctccttgtcctctttcctatcctttttgctctcttctttctcctgcccttctttcttctctgcatcccggttggcaatcttgttgttgatgaggttgtgcagggcgaccacggaacggatcagcgaggccaagtacactaccaccatctggtcattggtcttcaggtaaaaggccttgacgaactcctgcaggctgacatctggcagcaggttgaagacgtcctgcagctggtagatgatctggtggttgatgggcagcttgcctgtggcgactttttccaggtagctcctgatatccagaagcttggagttcagtcccttcaaaccatggacctggtttgtgatccgctgggacagagtgcccaccgtcgtgtctttgatatctctgtaataacccacagttaaaaagggcaggaaaaggcatcagggtaccatgttatcaggcaagttcttacattctaagaaaattcctagctttgttgggtgaggcaagtttttaaaagaaaaatgtcacttccccatttgataaagatttcgttatcaattaccttaatttcgttatcatttggaacacattttatctttctcatcacaggacatttttcaaaaaacaattataaaagggagctaaaataaaaccatttccacttaaggaaaaaaaaattgcttaggtcaacagttcagatctaccaataactttctgggtaaccttgtactgaagctgtctctctcagctttcctgttcctaaaaggatggcattttctctacatgcatctccagaatattgagaagcttaactaagatgg

SEQ ID NO: 405676 - DNA, 1322 bp, Homo sapiens
  misc_feature (76)..(76): n is a, c, g, or t
  misc_feature (808)..(808): n is a, c, g, or t
tcctcgtagaatgccgccacagtgttgcgctgtcttctgtccccggacgagagtttataagaggcaaaaggtggcntcgccacaaagtcgataggtgcgaagctggagttttcataggaggcccacattttgtgggggatatctcgtttggagaagtagcccgagatgtttgtggtggcctcggcaacgtatgtggttgcagaggatagaggattgaaagaggtgttgggtgtcgacaagatgtggtgcgaacaccgacacgctgggtgggtcgctccatcgcaagaacagccgggggccgcccgctgcagtgtcgcgaaaataatgtatggggagccccctttgcccccgaaaattggaacttgggtagaccaaattggggtttattcgccccgtcccggtgagatatctgtttttgtggggaagtattgagcccctcggaaagcagtgtttttggaggagcccccctgtctcctagaggccttgcccgcgcccgccgtttttgggcgccacccgggttccattgggagattccaagccgttaattgtgagcgtgttgaatgtcgccagatgtgcgtcccttaattgccagggatctgtttagccgggggtgcgccctgtgtgtgtccaagtccaggaaagggtcgcccaaggtttgtcctgccagtgtctgttggaccgaggggcgtttggaattgggccaatgtggagttggacacgttttccaggccctgagatttaagagggcctttttatagctcccgtccatgtgattataattaccgggaccgatgtgctgtttaggtgnccatcgggcccttggtgtccagtcatcttccctgtttgtcgacccggcttgaatgccccagggagcccacggtggatggagaaaccactggaatttgagaggccccaggtccgtttgttcccccccgaccaagggttagaaagtccaccaatcttccaattttgccgtcttttttttttttttttgtcctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacaaagcttagcaggagaggagagccagagaagtgacagggaagctacaggttacaacagatttgtgaactcagccaagcacagtggtggcagggcctagctgctacaaagaagacatgttttagacaaatactcatgtgcatgaacacaccacgg

SEQ ID NO: 405677 - DNA, 2288 bp, Homo sapiens
  misc_feature (76)..(76): n is a, c, g, or t
  misc_feature (808)..(808): n is a, c, g, or t
tcctcgtagaatgccgccacagtgttgcgctgtcttctgtccccggacgagagtttataagaggcaaaaggtggcntcgccacaaagtcgataggtgcgaagctggagttttcataggaggcccacattttgtgggggatatctcgtttggagaagtagcccgagatgtttgtggtggcctcggcaacgtatgtggttgcagaggatagaggattgaaagaggtgttgggtgtcgacaagatgtggtgcgaacaccgacacgctgggtgggtcgctccatcgcaagaacagccgggggccgcccgctgcagtgtcgcgaaaataatgtatggggagccccctttgcccccgaaaattggaacttgggtagaccaaattggggtttattcgccccgtcccggtgagatatctgtttttgtggggaagtattgagcccctcggaaagcagtgtttttggaggagcccccctgtctcctagaggccttgcccgcgcccgccgtttttgggcgccacccgggttccattgggagattccaagccgttaattgtgagcgtgttgaatgtcgccagatgtgcgtcccttaattgccagggatctgtttagccgggggtgcgccctgtgtgtgtccaagtccaggaaagggtcgcccaaggtttgtcctgccagtgtctgttggaccgaggggcgtttggaattgggccaatgtggagttggacacgttttccaggccctgagatttaagagggcctttttatagctcccgtccatgtgattataattaccgggaccgatgtgctgtttaggtgnccatcgggcccttggtgtccagtcatcttccctgtttgtcgacccggcttgaatgccccagggagcccacggtggatggagaaaccactggaatttgagaggccccaggtccgtttgttcccccccgaccaagggttagaaagtccaccaatcttccaattttgccgtcttttttttttttttttgtcctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtactttgccctcaatctgattggccctcgagctgtggatgtgctgtctgagttgtcctatgcccctatgactccagaccacttcccaagcctcttttgcaaggagatgagcgtgggctatgcaaatgggatccgggtgatgagcatgacgcacacaggagagccaggattcatgctctacatccccatagaggggaatgagatgctctttcataaatgataccaagtgcaagagaacttaaggcagctccaatcgaagactgtcttggctgcttctggaaactacagatcactactcccgaagtcaaaaacgactagaacacagcttaaaaatcaagccatttaattgtatctttgaaggttgtgcagggcgaccacggaacggatcagcgaggccaagtacactaccaccatctggtcattggtcttcaggtaaaaggccttgacgaactcctgcaggctgacatctggcagcaggttgaagacgtcctgcagctggtagatgatctggtggttgatgggcagcttgcctgtggcgactttttccaggtagctcctgatatccagaagcttggagttcagtcccttcaaaccatggacctggtttgtgatccgctgggacagagtgcccaccgtcgtgtctttgatatctctgtaataacccacagttaaaaagggcaggaaaaggcatcagggtaccatgttatcaggcaagttcttacattctaagaaaattcctagctttgttgggtgaggcaagtttttaaaagaaaaatgtcacttccccatttgataaagatttcgttatcaattaccttaatttcgttatcatttggaacacattttatctttctcatcacaggacatttttcaaaaaacaattataaaagggagctaaaataaaaccatttccacttaaggaaaaaaaaattgcttaggtcaacagttcagatctaccaataactttctgggtaaccttgtactgaagctgtctctctcagctttcctgttcctaaaaggatggcattttctctacatgcatctccagaatattgagaagcttaactaagatgg

SEQ ID NO: 405678 - DNA, 1441 bp, Homo sapiens
  misc_feature (27)..(27): n is a, c, g, or t
gcccagacctgcccaggcctgcccagnccctgctctaccctgatgctctgtggctctgttcctgggactcttcctgggagacagaagggagatgagagctcaagaaccagcaccgagatgccaatctagccggcaccagctgcctgttctctgggcactcctccctcatctcacagccacccagcctgcctttccagagtgacaaaagagtgcctgggtgccccctgctcaccctgatccacacttggtgtccagagacttttccccacaccttccaaccagcgagtcctccctctagtgttgccccatgggcagcttgggaagtggggaaggggctgcatctgctcctggaggacgtcacctggaagtacacagccctcaatctgattggccctcgagctgtggatgtgctgtctgagttgtcctatgcccctatgactccagaccacttcccaagcctcttttgcaaggagatgagcgtgggctatgcaaatgggatccgggtgatgagcatgacgcacacaggagagccaggattcatgctctacatccccatagaggggaatgagatgctctttcataaatgataccaagtgcaagagaacttaaggcagctccaatcgaagactgtcttggctgcttctggaaactacagatcactactcccgaagtcaaaaacgactagaacacagcttaaaaatcaagccatttaattgtatctttgaaggttgtgcagggcgaccacggaacggatcagcgaggccaagtacactaccaccatctggtcattggtcttcaggtaaaaggccttgacgaactcctgcaggctgacatctggcagcaggttgaagacgtcctgcagctggtagatgatctggtggttgatgggcagcttgcctgtggcgactttttccaggtagctcctgatatccagaagcttggagttcagtcccttcaaaccatggacctggtttgtgatccgctgggacagagtgcccaccgtcgtgtctttgatatctctgtaataacccacagttaaaaagggcaggaaaaggcatcagggtaccatgttatcaggcaagttcttacattctaagaaaattcctagctttgttgggtgaggcaagtttttaaaagaaaaatgtcacttccccatttgataaagatttcgttatcaattaccttaatttcgttatcatttggaacacattttatctttctcatcacaggacatttttcaaaaaacaattataaaagggagctaaaataaaaccatttccacttaaggaaaaaaaaattgcttaggtcaacagttcagatctaccaataactttctgggtaaccttgtactgaagctgtctctctcagctttcctgttcctaaaaggatggcattttctctacatgcatctccagaatattgagaagcttaactaagatgg

SEQ ID NO: 405679 - DNA, 1871 bp, Homo sapiens
  misc_feature (76)..(76): n is a, c, g, or t
  misc_feature (808)..(808): n is a, c, g, or t
tcctcgtagaatgccgccacagtgttgcgctgtcttctgtccccggacgagagtttataagaggcaaaaggtggcntcgccacaaagtcgataggtgcgaagctggagttttcataggaggcccacattttgtgggggatatctcgtttggagaagtagcccgagatgtttgtggtggcctcggcaacgtatgtggttgcagaggatagaggattgaaagaggtgttgggtgtcgacaagatgtggtgcgaacaccgacacgctgggtgggtcgctccatcgcaagaacagccgggggccgcccgctgcagtgtcgcgaaaataatgtatggggagccccctttgcccccgaaaattggaacttgggtagaccaaattggggtttattcgccccgtcccggtgagatatctgtttttgtggggaagtattgagcccctcggaaagcagtgtttttggaggagcccccctgtctcctagaggccttgcccgcgcccgccgtttttgggcgccacccgggttccattgggagattccaagccgttaattgtgagcgtgttgaatgtcgccagatgtgcgtcccttaattgccagggatctgtttagccgggggtgcgccctgtgtgtgtccaagtccaggaaagggtcgcccaaggtttgtcctgccagtgtctgttggaccgaggggcgtttggaattgggccaatgtggagttggacacgttttccaggccctgagatttaagagggcctttttatagctcccgtccatgtgattataattaccgggaccgatgtgctgtttaggtgnccatcgggcccttggtgtccagtcatcttccctgtttgtcgacccggcttgaatgccccagggagcccacggtggatggagaaaccactggaatttgagaggccccaggtccgtttgttcccccccgaccaagggttagaaagtccaccaatcttccaattttgccgtcttttttttttttttttgtcctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtactttgccctcaatctgattggccctcgagctgtggatgtgctgtctgagttgtcctatgcccctatgactccagaccacttcccaagcctcttttgcaaggagatgagcgtgggctatgcaaatgggatccgggtgatgagcatgacgcacacaggagagccaggattcatgctctacatccccatagagatggggcttcaccatgttgtccacgcttgtctccaactcctgacctcaagtggtccacacacctcagcctcccaaagtgctgggattacaggcatgagccactgtgcctggccccaggctgctggagtgcagtggcaagatctcggctcaccacaacctccgcctcccaggttcaagcaattctgcctcagcctcctgagtagctgggataacaggcatgcgccaccgtgcctggctaattttgtatttttagtagagacgaggtttcactatggtggtcattggtcaggctggtctcgaactcctgacctcaggtgatccacccacctcagcctcccaaagtgctgggattacaggcgtgagccacggcgcctggcccctcctgtgtttcaaaagctcagcccaagaccaccatcatcccacagtggagcctttccttccccaagagaatggcccctttgggg

SEQ ID NO: 405680 - DNA, 176 bp, Homo sapiens
tttgggatgaaattcttgccttgacgtctgtctccctcaacagtaaacagagggtgcagcactaatgaaaggtttccccaggcgtccctcccttgacaagcaatgtgagtgcccaggctgactgctgcctttgtccctgcaggagatgagcgtgggctatgcaaatgggatccggg

SEQ ID NO: 405681 - DNA, 206 bp, Homo sapiens
cttcaccatgttgtccacgcttgtctccaactcctgacctcaagtggtccacacacctcagcctcccaaagtgctgggattacaggcatgagccactgtgcctggccccaggtaatttttgagtagtttttttttttttttttaagtatttgtacttttgagaatctcataggttaacatgtttacaacaatctcttcatcttgtc

SEQ ID NO: 405682 - DNA, 315 bp, Homo sapiens
cctgggaattaataaaacgtattttcaaatgcataggcttagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacagagtttgagataacagtaagtatttgggaaccaaagtaatagattaggaaactttgcatatttattgaatgcctttt

SEQ ID NO: 405683 - DNA, 558 bp, Homo sapiens
gtattttcaaatgcataggcttagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacagagtttgagataacaaccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtactttggcctctcaaatccatgtttctccatccacctggctccctgtgcatccagccggtcatagag

SEQ ID NO: 405684 - DNA, 1563 bp, Homo sapiens
gtattttcaaatgcataggcttagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacagagtttgagataacaaccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtactttgccctcaatctgattggccctcgagctgtggatgtgctgtctgagttgtcctatgcccctatgactccagaccacttcccaagcctcttttgcaaggagatgagcgtgggctatgcaaatgggatccgggtgatgagcatgacgcacacaggagagccaggattcatgctctacatccccatagaggggaatgagatgctctttcataaatgataccaagtgcaagagaacttaaggcagctccaatcgaagactgtcttggctgcttctggaaactacagatcactactcccgaagtcaaaaacgactagaacacagcttaaaaatcaagccatttaattgtatctttgaaggttgtgcagggcgaccacggaacggatcagcgaggccaagtacactaccaccatctggtcattggtcttcaggtaaaaggccttgacgaactcctgcaggctgacatctggcagcaggttgaagacgtcctgcagctggtagatgatctggtggttgatgggcagcttgcctgtggcgactttttccaggtagctcctgatatccagaagcttggagttcagtcccttcaaaccatggacctggtttgtgatccgctgggacagagtgcccaccgtcgtgtctttgatatctctgtaataacccacagttaaaaagggcaggaaaaggcatcagggtaccatgttatcaggcaagttcttacattctaagaaaattcctagctttgttgggtgaggcaagtttttaaaagaaaaatgtcacttccccatttgataaagatttcgttatcaattaccttaatttcgttatcatttggaacacattttatctttctcatcacaggacatttttcaaaaaacaattataaaagggagctaaaataaaaccatttccacttaaggaaaaaaaaattgcttaggtcaacagttcagatctaccaataactttctgggtaaccttgtactgaagctgtctctctcagctttcctgttcctaaaaggatggcattttctctacatgcatctccagaatattgagaagcttaactaagatgg

SEQ ID NO: 405685 - DNA, 1989 bp, Homo sapiens
  misc_feature (76)..(76): n is a, c, g, or t
  misc_feature (808)..(808): n is a, c, g, or t
tcctcgtagaatgccgccacagtgttgcgctgtcttctgtccccggacgagagtttataagaggcaaaaggtggcntcgccacaaagtcgataggtgcgaagctggagttttcataggaggcccacattttgtgggggatatctcgtttggagaagtagcccgagatgtttgtggtggcctcggcaacgtatgtggttgcagaggatagaggattgaaagaggtgttgggtgtcgacaagatgtggtgcgaacaccgacacgctgggtgggtcgctccatcgcaagaacagccgggggccgcccgctgcagtgtcgcgaaaataatgtatggggagccccctttgcccccgaaaattggaacttgggtagaccaaattggggtttattcgccccgtcccggtgagatatctgtttttgtggggaagtattgagcccctcggaaagcagtgtttttggaggagcccccctgtctcctagaggccttgcccgcgcccgccgtttttgggcgccacccgggttccattgggagattccaagccgttaattgtgagcgtgttgaatgtcgccagatgtgcgtcccttaattgccagggatctgtttagccgggggtgcgccctgtgtgtgtccaagtccaggaaagggtcgcccaaggtttgtcctgccagtgtctgttggaccgaggggcgtttggaattgggccaatgtggagttggacacgttttccaggccctgagatttaagagggcctttttatagctcccgtccatgtgattataattaccgggaccgatgtgctgtttaggtgnccatcgggcccttggtgtccagtcatcttccctgtttgtcgacccggcttgaatgccccagggagcccacggtggatggagaaaccactggaatttgagaggccccaggtccgtttgttcccccccgaccaagggttagaaagtccaccaatcttccaattttgccgtcttttttttttttttttgtcctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtactttgccctcaatctgattggccctcgagctgtggatgtgctgtctgagttgtcctatgcccctatgactccagaccacttcccaagcctcttttgcaaggagatgagcgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttaatgccttctggggtcaaggatataaataacctcaccacgcccctggaatgtggacgagagtctcgggtgaaattagagaagggcatggatttcataggtcgcgatgccctcctgcagcagaagcagaatggagtgtataaacgcctcaccatgttcatcctggacagacatgattcagagctagacctttgagcttggggggaagaggccaataacgggatgggccagatgccggaaggacacaaggcgggccaacagtaaagcaggagagacagttggcagggcattggtcccaaacccagagacaggggaaaaccaagaggacgcagataccacaacgcggagcaacaagggaccacacgaaacccaaaccagcaaggagagcaaacgggagcacagacaaaacgacaaaggtactgaccaaaaaacaagaacagcacacgaaagcaaaccacaaagaaacaggcgcatgaaaagaca

SEQ ID NO: 405686 - DNA, 1137 bp, Homo sapiens
tggggaccagctgcgcacgaggccagcggcggggtcgctgccgttgaggcttcccgccactgctgctggcggatttgtggggcaaaatttctcgctggctagccttcttttccctcccgcactttggtggggagggggtggatcctcgtttcggtgcccaagttcacgatgacccgagagaactcgaggaagttgtcgccgcggccatttcccccagtgccgcaacttgctggccttggagggggaggagcgccgaggcagtgactgcgacgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaagtaagaaatttgttttgacttt

SEQ ID NO: 405687 - DNA, 1315 bp, Homo sapiens
  misc_feature (22)..(22): n is a, c, g, or t
gggggaaaaagacgaagaagangaaaccgaccaaccaccggcgcaaccacgaacacacaataaaataccgaccctcacccgagattgctgacatggctgccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggt

SEQ ID NO: 405688 - DNA, 1287 bp, Homo sapiens
  misc_feature (31)..(33): n is a, c, g, or t
  misc_feature (71)..(71): n is a, c, g, or t
acacaggcgctagcacaccaacacagcaccnnntggcaacaccaacgcgacaacgtccgactgtgatcctnccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggt

SEQ ID NO: 405689 - DNA, 2232 bp, Homo sapiens
tggggaccagctgcgcacgaggccagcggcggggtcgctgccgttgaggcttcccgccactgctgctggcggatttgtggggcaaaatttctcgctggctagccttcttttccctcccgcactttggtggggagggggtggatcctcgtttcggtgcccaagttcacgatgacccgagagaactcgaggaagttgtcgccgcggccatttcccccagtgccgcaacttgctggccttggagggggaggagcgccgaggcagtgactgcgacgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggt

SEQ ID NO: 405690 - DNA, 2196 bp, Homo sapiens
acccgaggcgacgcagtccgcttctccccacccgccaggtggcaggttcagggccggggtccgagcctgcttccctgcagctgccacagccaccctcgccgccagggggcgagagtcccaggcaggacaagcagcgctgctgccttggcgtgaaggtggtttcaaactttaggcttcttttccctaccccgcgtctctgaagagcagagaggaagatggaaaccgagtccgggccgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggt

SEQ ID NO: 405691 - DNA, 213 bp, Homo sapiens
tgggcaatgagtagaggctggaagggtttgagggagcaagctagaaaaagcctgtaattgctataagtggagcattaggggagattctgatgagggttcagaagacgagagctagggaaaagtctgaatcttcttcaagatttgcttaagtggtggtggccaaaatgttggtagaaatttgaacagtaaaggccattccgacaaggtctcaga

SEQ ID NO: 405692 - DNA, 1653 bp, Homo sapiens
ttcggggccgttttggcggctatgcaggattggcaggagctgcgatgctcacacttgcctcgccgaccgccatttcacatccagcagaggaggcgggggcagccgctgagacggtttttcacaaggaaatgacctcattcttgatggctgctgctaacttacggtgagatgctgggtccctgcccaataccacatggacatccaatcaatttacccagggacaagtccactcaagagcatcatttagaagagggaaaaggcactggggttatttgtttttggagtatgtgcttaaggaaatctagagtattcccacgagcattctgctgagatgaacaatcagatgacctcgtgtgagatttggaggagagaaggaaatggagagcatgcttctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccaccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaatttaaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttggcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgt

SEQ ID NO: 405693 - DNA, 1771 bp, Homo sapiens
ttcggggccgttttggcggctatgcaggattggcaggagctgcgatgctcacacttgcctcgccgaccgccatttcacatccagcagaggaggcgggggcagccgctgagacggtttttcacaaggtgcattttagtggttaccaggttgccacgtatttgaagtggtgtgagagctactcgtttggaaccgttgtggattttcaaataggaaaatcaaaaggcccaaagagacagctcactggaaatgacctcattcttgatggctgctgctaacttacggtgagatgctgggtccctgcccaataccacatggacatccaatcaatttacccagggacaagtccactcaagagcatcatttagaagagggaaaaggcactggggttatttgtttttggagtatgtgcttaaggaaatctagagtattcccacgagcattctgctgagatgaacaatcagatgacctcgtgtgagatttggaggagagaaggaaatggagagcatgcttctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccaccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaatttaaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttggcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgt

SEQ ID NO: 405694 - DNA, 1509 bp, Homo sapiens
ttcggggccgttttggcggctatgcaggattggcaggagctgcgatgctcacacttgcctcgccgaccgccatttcacatccagcagaggaggcgggggcagccgctgagacggtttttcacaaggaaatgacctcattcttgatggctgctgctaacttacgtattcccacgagcattctgctgagatgaacaatcagatgacctcgtgtgagatttggaggagagaaggaaatggagagcatgcttctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccaccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaatttaaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttggcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgt

SEQ ID NO: 405695 - DNA, 1556 bp, Homo sapiens
caagttcgaaatttgcccctgaattaggacccttgacacatttctaacccatccaagtagagatcgttcttttacatttgtgtgttatacaggtgcattttagtggttaccaggttgccacgtatttgaagtggtgtgagagctactcgtttggaaccgttgtggattttcaaataggaaaatcaaaaggcccaaagagacagctcactgtattcccacgagcattctgctgagatgaacaatcagatgacctcgtgtgagatttggaggagagaaggaaatggagagcatgcttctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccaccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaatttaaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttggcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgt

SEQ ID NO: 405696 - DNA, 519 bp, Homo sapiens
ctagagaatattattttaaagaaaaaatggcaacaatacattgtatattttcctccttggtaagctaacaaatgctatgtttggtaaaaacaaacacaattatctacctgttgaagctcacacaacttttactatttaaggttgttttctttaactgttattagaagaaaataattatgctcaagtcatatctgtctcatttccctgtaggtgaccatgctttgggattttcatagtttgagtaattcctatgggctctaccacccagcgagttaaagaagacaagattccacccccagggggttgtggttctgggaatgtgagcagcttgttttcaggagatctgcatcttgatctggcctgctattaggatctgtggtggtggtgcctgtctggttttagttgtttcttttatcttacacagatttttgtaagttatttgcatataaaggtttttgaaaagtgaatgttttatgggggcatcttgcttatacaaagaaaaattaaaactgttttaaa

SEQ ID NO: 405697 - DNA, 1032 bp, Homo sapiens
ttcggggccgttttggcggctatgcaggattggcaggagctgcgatgctcacacttgcctcgccgaccgccatttcacatccagcagaggaggcgggggcagccgctgagacggtttttcacaaggtaagaaaatccgcccgcgtgaggagggaggcgaggcgcagatctcgtgccgctgcggcctcgcgggagggaagggcgggcgggcggcggaacgggcggggccgggtgcggacgcagccggcccttctcaggtaacgccgcggctccgcgcgtggcccgggggcggtgcgaagggtgggggcgcgcgggcgcgggcttcggcctataaaagggccgccctggcgttcccccttcccgaacgtgccgcgcgagccgcggtgccccctcctctttgctgctgcagtgtctgcgccgggccatttaatgagatttattcacgcacggctcttctcagctttgcgaggggttggcagatccagtgcacagggatttcccactaccgtgtttttctcccgcccccttccttccctctcgtcctaatacatccttcgttggtttcctcggccccgcaggctgcgtcccgggcacgcgcaagtacatgtgcattttagtggttaccaggttgccacgtatttgaagtggtgtgagagctactcgtttggaaccgttgtggattttcaaataggaaaatcaaaaggcccaaagagacagctcactggtgaccatgctttgggattttcatagtttgagtaattcctatgggctctaccacccagcgagttaaagaagacaagattccacccccagggggttgtggttctgggaatgtgagcagcttgttttcaggagatctgcatcttgatctggcctgctattaggatctgtggtggtggtgcctgtctggttttagttgtttcttttatcttacacagatttttgtaagttatttgcatataaaggtttttgaaaagtgaatgttttatgggggcatcttgcttatacaaagaaaaattaaaactgttttaaa

SEQ ID NO: 405698 - DNA, 798 bp, Homo sapiens
ttcggggccgttttggcggctatgcaggattggcaggagctgcgatgctcacacttgcctcgccgaccgccatttcacatccagcagaggaggcgggggcagccgctgagacggtttttcacaaggtaagaaaatccgcccgcgtgaggagggaggcgaggcgcagatctcgtgccgctgcggcctcgcgggagggaagggcgggcgggcggcggaacgggcggggccgggtgcggacgcagccggcccttctcaggtaacgccgcggctccgcgcgtggcccgggggcggtgcgaagggtgggggcgcgcgggcgcgggcttcggcctataaaagggccgccctggcgttcccccttcccgaacgtgccgcgcgagccgcggtgccccctcctctttgctgctgcagtgtctgcgccgggccatttaatgagatttattcacgcacggctcttctcagctttgcgaggggttggcagatccagtgcacagggatttcccactaccgtgtttttctcccgcccccttccttccctctcgtcctaatacatccttcgttggtttcctcggccccgcaggctgcgtcccgggcacgcgcaagtacatgtaaggacttgtcagctgccggtgacctccctcctccctcgtcgctcctcccccagcggaatgtaggattaacagtctttccgagaaaattttggccaaagaaaaaggcctgtgaaagtcaccgcgttagacgtggcctcctcgtgtttttcactaacacgttatggaaggttttactacccgaaggcataaa

SEQ ID NO: 405699 - DNA, 269 bp, Homo sapiens
ctgggtccctgcccaataccacatggacatccaatcaatttacccagggacaagtccactcaagagcatcatttagaagagggaaaaggcactggggttatttgtttttggagtatgtgcttaaggaaatctagaggtaagcagtttttgagtgttactagtggtgtcagaatcactaaaaacattcatacaaaatgctggttactttttaagcaaaaagcaaaaaagtgcattttattttactgtgtacatgagaaatagctgaggtt

SEQ ID NO: 405700 - DNA, 1471 bp, Homo sapiens
ttcggggccgttttggcggctatgcaggattggcaggagctgcgatgctcacacttgcctcgccgaccgccatttcacatccagcagaggaggcgggggcagccgctgagacggtttttcacaagtattcccacgagcattctgctgagatgaacaatcagatgacctcgtgtgagatttggaggagagaaggaaatggagagcatgcttctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccaccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaatttaaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttggcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgt

SEQ ID NO: 405701 - DNA, 629 bp, Homo sapiens
gccttctgccatgattgttaagttccctgaggcttcctcagccatgtggaactgtgagtcaattaaacctctttcctttataaattgccctgtctctggcagttctttatagcagtgcgagaatggactaacacaatatgtcattcatttctttctattacttttcctgtcagtgacgtgttctttcttgagaataaacaatgagaggaaagttgacctcatttttaatgaaaagaaaaattttctgctcattttctagataaaagaacaaattgttattgaataaacagagaaaatatgataaatcctccaaaatagcattgaaattcctttctacccacagaaagaaaagctcaagagcaatgcaattttatcatgtcatacaatatcaggtgtgctgcatgtctacacagaaagtaggacatagcaatatctgaaagtgaattttttttttaattgagatatagttttgttctcgttgcccaggctggagtgcaatggtgcaatcttggctcaccacaacctccgcctcccaggagaatggcgtgaatcccggaggcagagcttgcagtgagccagcatcgcgccactgcactccatcgtgggcgacaaagcgagactccgtctca

SEQ ID NO: 405702 - DNA, 687 bp, Homo sapiens
gggagtggatcacaaggtcaggagttcaagaccagcctggccaatactgtgaacccgtctctactaaaaatacaaaaattagctgggtgtggtggcgcacacctgtagtcccagctactcgggaggctgaggcaggagaatcacttgaacccgggagacggaggttgcagtgggctgagatcctgccattgcactacagccccggcaacaagagcgaaactccgtctcaaaataaacaaataaataaaataaaataaaataaagtctccttccaacttttcagtctgtgaaacaaagatttgatctattcctcaaggcaagttgttactagctgagggtggcttggatttacctcagattaatgagtttttaaaatctgagttgattcttttcaataattttctattcaagcaggacagagctgggtaaaaggtaaaagggaggcaggggtctgacaggatcacagcgctgctgtgagaaaaaaacgactccacagcctgaaattttattattttttccttattatcttttttttctgagacagggtttcactgtcaccaaggctggagtgaagtggcgtgatcactgctcactgcagccacgacctcccggggcttagctgatcctcccacctcagcctctggagtagatgggactacaggcccgcgtcagtacgcccagctagtt

SEQ ID NO: 405703 - DNA, 309 bp, Homo sapiens
ggcaaaaacctggataatttttttcagaagatacatgcatggcaaacagaaaacgaaaaagttctcaacattcctaattatcagaggaattcaaatgagaagcacaatgcaatatcaactcacactagttaatatggctattatcagaaatgtaacagatgacaaatgttggcaagaatgtgggggaaagggaaatatcctgtggtaggattggttacttgataagttaaaaataaagctatcatataatctggtgatcccacttcttgttatatatgcaaaggaaataaaattactttgccaaagaca

SEQ ID NO: 405704 - DNA, 363 bp, Homo sapiens
ttagagggtttattttaaagtccaagtctaaagaatttgctctcagcagatgtttctgaatattctaaataaaaaaaatcataatgaatatagtttctaaatatactccaaaatggatgacctgtgaagaattgatacgatacctggctagcaggtgtcatcatggattagaaagaaactgcttttatgatgcatatattgttatggtttaaaataacaacaaagattaacaacagcagttgtaatgagtggcagtcatcatcactgttataataacaattatatgaaggctttgcagagaaaaagatattttaaggaaaagtagctgagctattagaagaataacattaaggctggtcacag

SEQ ID NO: 405705 - DNA, 550 bp, Homo sapiens
tactgaagctgttaatggatgtgtggatggttcctcacattcttctgtttactttctatacgtttaaaattttccctagtaaatgagttaaatttaatcacctattgcatccctgatatacgtctgccttgcatgttcacacctgtgacctcattaaatcctcccagcaatcctgtgaggcaagtccattgtccaggagaagaaaatgagacgtggagaaccagccaaggacccccatgtcgcctttcatccctcctgccactgcccaatgcaggtctttaccgtcacagacaggaagtgctcccgatcacggacaaaattccaaaggcatcgtgggtcagacagcacggaatgagtagtgcagggcaggtaagcagacctcacagaggtccagaggacaggaggcagtcagggttgctttcctgacaagactcctcctcctcctacacccctccagcccagggacactggagtgggcgggccctgggacacagcatcccccgaactacccagcaatcagaactccagtggtcacagccgtgcttcactg

SEQ ID NO: 405706 - DNA, 971 bp, Homo sapiens
tgggggctcagggtgctcagccctgggcattacataaaagctgtttattgacattacgttcttcagagtaacaaacccccttggaggactctcctgccgggatgtccatgtccgcctttgctccgagctggggtctcatgtctgtggtgctggaatccagagccctgacggtaggggagtgattttgcaacacagttgcatttcacatcttctgacaggattccttgagggagggttggaccctggcacctggccagctccaggaagggtggccaggcccctcactgccccatcaagagtacttggtgttggagatcttcttccagagcagagtcttgaggtggctgagcaccagcgagtgatgggcctccacctggctggccagcccgctcagcgtggtacaggtgcgcagctgtgtgcccagctcctcgcggaggtcggcgggcgcgccaggcagcaggtagccccgtagcagtgcgcacaccttggccaggttgggctggatgaggtcgcccttgcactgcctcatgagcctgtcacacggggccctgcagtcgcgcccgtaggtgcagtcggtgctgtgctcgcagcggcggccctgcaggaagcggcgcacggtggcctcgggtgccacctgctgcaggtcggccatcttgaagtcgtaggtggctgtgtagcccacgttggccagtgtggtctcacacatgtagaaagtcccgtaagagccgtggaagagctcctccacgaactccagcaggccgatggcgatcttggcccgccaaggccacgcaggccccagccactgctggagagcaccctgcagggcaggcggcagcagtgggcgcaacaggggtgggagggcggccgcgtgccaggcgccatgcggcacgccctcggtgaggtagaggtccccacagtagcccagcagtctggaggcgtgctccttctcctgcagggacagcagcagcagg

SEQ ID NO: 405707 - DNA, 1233 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatggaatggattgtcttgactcacacattgcggagcagagcccgccctgaagaaaggtgttgctgtggtgggatcttcccacgagggtccttgcctgttctcctaggggatggttgctgggtgccctgggctactggggagagcgtacggggctggagaagatggccattcctgggctgtttcctagggaatgagttgtacatctcatggctggattttgtaaaatcagtttttaaaataccgcatatatctgttttcttactgga

SEQ ID NO: 405708 - DNA, 794 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 405709 - DNA, 472 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 405710 - DNA, 857 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatgga

SEQ ID NO: 405711 - DNA, 1481 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttgggtaagttggtgcattggagctggaacagggtcaatcctccaatgtaactaagccctcctgtgcaacatcttaagtgactggagggaccagtcggtcttgtgttcacattgaggctagaagctgtctccaggggagtaaaaacggattatttagtcttcaacaggacactgcccctagaggcgttgcagctgtggctgccgtgtcacatctgtgtcattaggtggcagagattagagaggctatgtctacgctcagcgttctgccccgtgaacgtttgaatgtttgatagtctcacactcctgttttgtggacaggcatctgttttcctttgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtctggtgtgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatgga

SEQ ID NO: 405712 - DNA, 921 bp, Homo sapiens
tgggggctcagggtgctcagccctgggcattacataaaagctgtttattgacattacgttcttcagagtaacaaacccccttggaggactctcctgccgggatgtccatgtccgcctttgctccgagctggggtctcatgtctgtggtgctggaatccagagccctgacggtaggggagtgattttgcaacacagttgcatttcacatcttctgacaggattccttgagggagggttggaccctggcacctggccagctccaggaagggtggccaggcccctcactgccccatcaagagtacttggtgttggagatcttcttccagagcagagtcttgaggtggctgagcaccagcgagtgatgggcctccacctggctggccagcccgctcagcgtggtacaggtgcgcagctgtgtgcccagctcctcgcggaggtcggcgggcgcgccaggcagcaggtagccccgtagcagtgcgcacaccttggccaggttgggctggatgaggtcgcccttgcactgcctcatgagcctgtcacacggggccctgcagtcgcgcccgtaggtgcagtcggtgctgtgctcgcagcggcggccctgcaggaagcggcgcacggtggcctcgggtgccacctgctgcaggtcggccatcttgaagtcgtaggtggctgtgtagcccacgttggccagtgtggtctcacacatgtagaaagtcccgtaagagccgtggaagagctcctccacgaactccagcaggccgatggcgatcttggcccgccaaggcgagcacagcaccgactgcacctacgggcgcgactgcagggccccgtgtgacaggctcatgaggcagtgcaagggcgacctcatccagcccaacctggccaaggtgtgcgcactgctacggggctactgctgcctgg

SEQ ID NO: 405713 - DNA, 683 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagagtaacaaacccccttggaggactctcctgccgggatgtccatgtccgcctctaccccaactgccctgacgctgtaaactgccctgacgctgcaaactgccctgacgctgtaaactgccctgacgctgtaaactgccctgacgctggaaactgccctgacgcttgtaactg

SEQ ID NO: 405714 - DNA, 909 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 405715 - DNA, 972 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatgga

SEQ ID NO: 405716 - DNA, 1533 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttgggtaagttggtgcattggagctggaacagggtcaatcctccaatgtaactaagccctcctgtgcaacatcttaagtgactggagggaccagtcggtcttgtgttcacattgaggctagaagctgtctccaggggagtaaaaacggattatttagtcttcaacaggacactgcccctagaggcgttgcagctgtggctgccgtgtcacatctgtgtcattaggtggcagagattagagaggctatgtctacgctcagcgttctgccccgtgaacgtttgaatgtttgatagtctcacactcctgttttgtggacaggcatctgttttcctttgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtctggtgtgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 405717 - DNA, 386 bp, Homo sapiens
ggtatctaaggatctcagtttaagcgtcaggcaggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 405718 - DNA, 1418 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttgggtaagttggtgcattggagctggaacagggtcaatcctccaatgtaactaagccctcctgtgcaacatcttaagtgactggagggaccagtcggtcttgtgttcacattgaggctagaagctgtctccaggggagtaaaaacggattatttagtcttcaacaggacactgcccctagaggcgttgcagctgtggctgccgtgtcacatctgtgtcattaggtggcagagattagagaggctatgtctacgctcagcgttctgccccgtgaacgtttgaatgtttgatagtctcacactcctgttttgtggacaggcatctgttttcctttgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtctggtgtgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 405719 - DNA, 909 bp, Homo sapiens
ctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggtgagagctgagtgcgcgaattcggatcttagagaaaggcaccccgttcacccacgacccttccgctcctgccgctgcttccctgagtcgctcaggctgtgggaagatgtttgtcggcatctttgaaaaattgatttcttatgctgcgtcaggtggtttccttgtcactgtggctgctcagcgggaggctgttctggcgggaggaggactgctcggttgtctggtgggcattccgcctcgtggtcctggtcccttgatacctgcaggggatcagcagcccgcgtttcgtggccactgtgttgtaactccaacttcccctcccgcaaattaagcgtagagtaaggggagagagtaacatgggtcggatttttctagaacggcccttgtgacagtgagctttttggtggcagggagcttctttggtccgccttcctggagaccagatgcagcaaaacgcagtctttttcttttcgagacagagtctcagttgcccaggctggagtgcagtggcgcgatctcagctcactaccacctctgcctcctgggttcaagcgactttcctgcttcagcctccagagtagctgggattacaggcgccagccactaggccagctaactttttt

SEQ ID NO: 405720 - DNA, 3515 bp, Homo sapiens
aaaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacgtcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggagccttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccag

SEQ ID NO: 405721 - DNA, 557 bp, Homo sapiens
aaacaagagaaagtagacagatatatgttggtaaatgctaactgtccatattcacatagagacacagtgtaccctctgagcccaatatacagagaaaggaggaaaaaagctagaattctatgcactactacacaggggcctagcactctccagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccag

SEQ ID NO: 405722 - DNA, 448 bp, Homo sapiens
aggagtcccctacgtgctcgacaaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccaggtaagaacttcaggctcctcttgatttcttaggcattacgtgggtataaccggacgaaacctgtgtgtgcaaggcagagcaaatttgtgtcttggcgttggaacacagtgccaggttatcgaccataaagggttgtcgtctcacttagct

SEQ ID NO: 405723 - DNA, 1343 bp, Homo sapiens
aaaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacaggtattactgttatccacattttacgaagaagaacagaggcttaggaaagttaaataaccaaggccatgcagcaagtaatggaggaactggatttctacctcagttctgtttggctgcagagaccaagctccttactcttgtgtgaagacttacagtgaaggttaattcctggctcctgtgctatgtaggggccatgcatctgtgtcttccacagtacctaacgtgggaccttttacagaatggtcactcaataaaggtgatttggttttgcagctatccattcatgc

SEQ ID NO: 405724 - DNA, 1255 bp, Homo sapiens
tagaggaattggatgttccttctcctaggggaagtttggacatcatgcatttaagcacattcctgtaatggaaataagaagcaacaggcaagagatccctagtgctgtgtagcctgtaatccgcaatcaggcagagactcggggactcagagactcgaaaggcaagggaggtaggaagtaattgtggtagaggtgatggatggagcagcattctcatttggaatgggaacagggcgtaggaattttctccaggccgtctgaatctggaggagcagcttgagaggagagaatgagagagatccaggcgctagggtagaatggtaatgaatgtttccgcttcctgggcacgggctgagatgcgcattccccctcgcccctctctcctgtgcggtctccagtgtgctttgttggtggagagaaaagattcgttttcccccacccctcttttctccttgggtgaatgggttcctaggaatatggattgacacacccttcacaaggtggattcttgcttcccttaaaacagactccattagttaacattcaactggaaaaatgctgcttcttcatccttaccttatcttgattgatttaacagttaagaatggctggtgaggtctggtagatgagtgagctgagacttttttcttttttcttttctttaccttttggaagaagctgagtcaaagagtctgattgcaaaccctaaactgttgcttgacatatggggcataatgatctctgcagggagagatgcaattctgtgggcagtcaggcttcactccgagctctgttttcatggactaatgcatctcttgttgatctttccttctgggaacaacgcagcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacaggtatgtccaggggcggatgcccttcaggaagaaaaaaatgtgttctgccttttctttgttaatattggcactgatgcctgggttcttgttcatcatttgcagagttccacatggctgggggaggtctcataatcatggcagaggacgaaaga

SEQ ID NO: 405725 - DNA, 1278 bp, Homo sapiens
tggagcttggagaccccggtcctgacagcttccctccccgctctcttttctttcagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacgtcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggagccttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccag

SEQ ID NO: 405726 - DNA, 234 bp, Homo sapiens
ttacccttgttggccctaggtggttactgtgtgattttactgttattaaatctattataaactgcttcattattcctgaccttgactctatctctcctttaatccttccgtcgccctctcagaaatcccatgctgttggcccccaggaaatccgagagcgagccacagtcttgcagacggtatttgaagattacgtgcactccagtgagaggagggtctcctgggcaaagaaag

SEQ ID NO: 405727 - DNA, 2409 bp, Homo sapiens
aaaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacgtgaagaactcaccctaagccagaggaaaggaaccttgcttttaataccatcattatgttgacgagttgataagaagtaccaccgaatggccggaaaatggagtttctaagccacctgattttaaggctgacattaggttttctgttggtctccggtggctgtccttgattgtccctggatggagtgcagtcacctttttcccagaaaggaaagatacctgcagcccgccctgggcgccaactgtcccttggcatcctccttggctgtccggcgcgtgcatttctttttcagaagatgcacctaaatcacctgtgctgctttcctccaccttctccgtatttttttccgcttgaagcatactgttctgtctgtgcagttcttaatttcctctcctcctggggaatttccaccgtgccaggaggctaggagacaaaggagatacggctgtgaagagtcacaatgtcagttctgtgtcccaaataaatgtagactttcgtgctt

SEQ ID NO: 405728 - DNA, 3920 bp, Homo sapiens
tagaggaattggatgttccttctcctaggggaagtttggacatcatgcatttaagcacattcctgtaatggaaataagaagcaacaggcaagagatccctagtgctgtgtagcctgtaatccgcaatcaggcagagactcggggactcagagactcgaaaggcaagggaggtaggaagtaattgtggtagaggtgatggatggagcagcattctcatttggaatgggaacagggcgtaggaattttctccaggccgtctgaatctggaggagcagcttgagaggagagaatgagagagatccaggcgctagggtagaatggtaatgaatgtttccgcttcctgggcacgggctgagatgcgcattccccctcgcccctctctcctgtgcggtctccagtgtgctttgttggtggagagaaaagattcgttttcccccacccctcttttctccttgggtgaatgggttcctaggaatatggattgacacacccttcacaaggtggattcttgcttcccttaaaacagactccattagttaacattcaactggaaaaatgctgcttcttcatccttaccttatcttgattgatttaacagttaagaatggctggtgaggtctggtagatgagtgagctgagacttttttcttttttcttttctttaccttttggaagaagctgagtcaaagagtctgattgcaaaccctaaactgttgcttgacatatggggcataatgatctctgcagggagagatgcaattctgtgggcagtcaggcttcactccgagctctgttttcatggactaatgcatctcttgttgatctttccttctgggaacaacgcagcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacaggtatgtccaggggcggatgcccttcaggaagaaaaaaatgtgttctgccttttctttgttaatattggcactgatgcctgggttcttgttcatcatttgcagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacgtcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggagccttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccag

SEQ ID NO: 405729 - DNA, 853 bp, Homo sapiens
  misc_feature (837)..(838): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 405730 - DNA, 398 bp, Homo sapiens
  misc_feature (50)..(50): n is a, c, g, or t
  misc_feature (398)..(398): n is a, c, g, or t
cgtatacccccccccccgcacggttttaactccccgctaactccagaggncttaggccccgagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaacctgccgtgggggatgcgctctagn

SEQ ID NO: 405731 - DNA, 8465 bp, Homo sapiens
  misc_feature (6693)..(6694): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405732 - DNA, 8496 bp, Homo sapiens
  misc_feature (6724)..(6725): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405733 - DNA, 8099 bp, Homo sapiens
  misc_feature (6327)..(6328): n is a, c, g, or t
tgtctcagtttcgggacgtcccgaaactgagacatgtctcagtttcgggacggcagcaggagggtggagtctccgaggagatgaagggcccacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405734 - DNA, 6709 bp, Homo sapiens
  misc_feature (6693)..(6694): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 405735 - DNA, 7638 bp, Homo sapiens
  misc_feature (6693)..(6694): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaactcccgagtccctgagaaccatgacccttgttccgccgcattccggatcctctggaacgccacc

SEQ ID NO: 405736 - DNA, 6740 bp, Homo sapiens
  misc_feature (6724)..(6725): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 405737 - DNA, 6366 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctacagaccacatgggtgaaggcccttcctaggccctgccattaccctcttcctccatgtagcacttggcccatgtctcattacatctccttacccagtttttacagccccgtgaatagagccttcaccca

SEQ ID NO: 405738 - DNA, 6212 bp, Homo sapiens
  misc_feature (6212)..(6212): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaacctgccgtgggggatgcgctctagn

SEQ ID NO: 405739 - DNA, 6608 bp, Homo sapiens
  misc_feature (4836)..(4837): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405740 - DNA, 8374 bp, Homo sapiens
  misc_feature (6602)..(6603): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405741 - DNA, 8256 bp, Homo sapiens
  misc_feature (6484)..(6485): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405742 - DNA, 5066 bp, Homo sapiens
  misc_feature (3294)..(3295): n is a, c, g, or t
ttccggttacggcactgcttcggatgcacgcacctgtaggcagcaggaaccaccatccgctttttatgtcgtagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405743 - DNA, 2728 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttccagactctattccgacaccctcccacatggaggaaacgcaacagaaatccaatctaactgct

SEQ ID NO: 405744 - DNA, 4690 bp, Homo sapiens
  misc_feature (2918)..(2919): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaatttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405745 - DNA, 2609 bp, Homo sapiens
  misc_feature (837)..(838): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405746 - DNA, 2833 bp, Homo sapiens
  misc_feature (1061)..(1062): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaatttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405747 - DNA, 2628 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacagagagagcgtcccccacagagagagcgtcccccacagagagagcgtcccccacagagagagcgtcaccccacagagagagcgtcccccacaga

SEQ ID NO: 405748 - DNA, 2538 bp, Homo sapiens
  misc_feature (2496)..(2496): n is a, c, g, or t
  misc_feature (2524)..(2524): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccctnacgccatcactctggatttatcaggatnaaatgggaccggcc

SEQ ID NO: 405749 - DNA, 2344 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccagacccttcttgcgccaccaccccctcgctagcacccccgatcccatcagagagagctga

SEQ ID NO: 405750 - DNA, 924 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgcgtagtcagatcggaccgagcc

SEQ ID NO: 405751 - DNA, 6080 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaactcttgggggggcccggtccccaattttcccctttgggaggcccttttccttttattggcgccggttttactaacctgtgtaactgggaaaact

SEQ ID NO: 405752 - DNA, 6164 bp, Homo sapiens
  misc_feature (4392)..(4393): n is a, c, g, or t
cggcccacggcgggtgtactccacccgcggtgtacgctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatctacaagatctcctctcctcccaagcagtaagctcccttcctccttccaggattcaattactccatgccctctttataaaaaatcccaaattcagtcttaccagaagtgcttccctcaacccagcatccttactccccgtatcctcttcccttcctactcattcttccactgatatcctggaccacgtacagccacatttcccaaacatttcctccgagcctctcaccaaccccgatgatcaactattcatagatggctcctcttccaggcccaccagctaccccccagattgctggatatgcagttgtttcccttgaccaagtaattgaagccaggatcctcctcccaaaaagcagaactcatagctctcaccagggccctaaatctttccaaaggcaaacgagtcaacatttatacagactccaaatatgcctatcacattcctcgttcccacgctgctatctggcaaaagagaggactccttactgccaaaggaacccctatcactaatggccaccttatttactaactccttcaggccacacacctcccagctaaagcaggagttatacactgttgaggacatcgaacaggttcagatgaaatctcgaggcaacagaaaggccgatgaggcagcaaaagaagcctccctttcttctgcctctgcccctctccttcctgttatcccagcaatcctacccaagaactctcccaccgagaaagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctacatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagagcaagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaaccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaatttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggaaggattccatactttattttatgggtgattattgttccattgtgtgtataccatat

SEQ ID NO: 405753 - DNA, 2803 bp, Homo sapiens
  misc_feature (2767)..(2767): n is a, c, g, or t
  misc_feature (2797)..(2797): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccaacgttcctcaataccccaancagagagagctcgggatcctctagatcacncagcac

SEQ ID NO: 405754 - DNA, 2700 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccgtaaggtttctcccaggtacggacttctctgcacgtgcgagtcctatgcgtgaagcctgca

SEQ ID NO: 405755 - DNA, 2642 bp, Homo sapiens
  misc_feature (2606)..(2606): n is a, c, g, or t
  misc_feature (2636)..(2636): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccaancagagagagctcgggatcctctagatcacncagcac

SEQ ID NO: 405756 - DNA, 2490 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttcgaacgctgttaaactacgcgcagcgacagcgctatcacgggcccactggtctcctg

SEQ ID NO: 405757 - DNA, 2012 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaacctggccaagtgtactgtagccatatgattacttgcctcattgcaggccttaacaaagctgcccataggctgtaaattttgaaaaacttaaagacatttcccaaaaggcagatgaaaatcctgcccaatctctttcccgccttacagaagctctccaaaaatatacccgcatcgaccctgcctcctgagaaggaactattgttctttctttaaaaaattttatttattttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctctactctctaccctagtctccttttccagctccgagacctgagcaagccagg

SEQ ID NO: 405758 - DNA, 1586 bp, Homo sapiens
  misc_feature (1557)..(1557): n is a, c, g, or t
  misc_feature (1561)..(1561): n is a, c, g, or t
  misc_feature (1563)..(1563): n is a, c, g, or t
  misc_feature (1565)..(1565): n is a, c, g, or t
  misc_feature (1568)..(1568): n is a, c, g, or t
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaacttttcaggggctggccccgtcccaagccgggggggtgggggttggtggancagncnanttncggtcccggaaggggata

SEQ ID NO: 405759 - DNA, 1689 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtggctcggtcctttggtattgcattgcaaacagttcaaacggcaacagggtagcgaaccatttcacggcttctaattttatcccgttaaggggaacttttttgttcgcccacacccatggcttggcc

SEQ ID NO: 405760 - DNA, 1195 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatcacttgccgtagcctcaggctccacattccttgtgcttcgccgacccctcttgcgtttagccccgtcccccgcttagctctttgttgtcggcctaagcctttcacacctatcgggaatttcccggcctcgactgcttcgcttct

SEQ ID NO: 405761 - DNA, 1335 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtacgtcctgggatccaggagcccaaccaggaagtggggggaagggtcgcacagaaggcgggcgcccgaggggtggcggggagcgaactctaaagacatggccagggaagcggcttaggagaggccagagcggggcgcagaggcagaacagaagtcaaactggtgggaggcgcctttagtgacctgaagtagtgagtctaggaaggggccgggggcagagggcaggaccaggctctcggcatctccgaggcggcggactcggatggagcagtttctgagtgacggcctccccgggcctgggcgtcaagggcgaaggccgaaagccggcgttagaaagaggaacgccagttcttaccgaagacctcaaggtcgcggcaaggagataactgcccgggggaggccatgcgcccgggtccagcggcctcccagcccgcggacgcgctcaaacctcgccgggccggaagccggcgccgggaagcgcgtgtgccttttacgtccgcccccgcgcagccgcggccgct

SEQ ID NO: 405762 - DNA, 320 bp, Homo sapiens
  misc_feature (305)..(305): n is a, c, g, or t
ctcggtacccaagtacccacctgcccaagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagtgggtactcaaaagtacatcntgcaggtggggggga

SEQ ID NO: 405763 - DNA, 2621 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaaacaaaaaaaaaaaaaaaaaaaaaaaaatttaaaagaaaaaaaaaaaaaaaaaaaaaaaaatgtgtgtggggggcgcgtggggcccggggaaaaagtttttttacaaaaatctgggtggggggggggggacccaaattgggatgaaaggtgggaaacgggggcacaaaggtgtgttcaaaaagagaccctgtggcgacaacaagagcgtggggtggatctcacccaaaaaaaaaacaacgccgggtggggcaacacagggcgtttgtagacacacaccaaaggagcgctaggggagcaaaggggcgccaacaacaagggggggcctacagcgacggccgagagaataaaaattccgcgcgacgtgggatgggaagaacgatacaacacatgagacaacagacagacgaacgagaaaacagagaggacgacagcaacagacctaacaggaagacaaatgaagaaagaggacagagacgagagaggagagcagagacgaacgaaggacgcaagagagacagaaagaacagaaggagcaagaggcgaagacagaagacacgaaggaaagaggagaacgaacgagaggaggagaagcaatggagagagaaagaagaacggagagaggagagagacggcagagtgaagaagagagggaggagccacgaacgaaggagaaacagacgaaacagagagacagcaacgagacaggagaagagaacagaagcaaagaaagcaaaggcagagagacaacgcccgggcacga

SEQ ID NO: 405764 - DNA, 1958 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaaaaaagggggcgtctaaaatatcctcgagggcaagttagcgctcacggtcttgtaaagggccctttggggagtaaagaagagggccgtaaaatggaag

SEQ ID NO: 405765 - DNA, 1238 bp, Homo sapiens
tcgacggacgcgtgggtcgacccacgcgtcccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405766 - DNA, 1792 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405767 - DNA, 1179 bp, Homo sapiens
tcgacggacgcgtgggtcgacccacgcgtcgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405768 - DNA, 1819 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405769 - DNA, 1086 bp, Homo sapiens
tcaaacggttcccggcagtcgcgcagcacgctttcaatgacagggtgtccgccgatcgagggaggggcttcagacgtccctgacgtcccggggcagagcgaggtaggatactcagcttgcgggcgtccagagcggagtcgcttctggcgaaccggcaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405770 - DNA, 1889 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcaggctggttgggggaacccaaacggaaatggaaaaaaaacccccccaaagggtttttttgggccgcctttactttttgggcaggggtctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405771 - DNA, 1745 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405772 - DNA, 649 bp, Homo sapiens
  misc_feature (35)..(36): n is a, c, g, or t
cggctgctagaggaccctcataggttcgcaggcgnngggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405773 - DNA, 686 bp, Homo sapiens
tcataggttcgcaggcaagatcatccaatgcaacccttgtgtacagatgacgtgtttaggggatgtggggaaaggaagtcagtaaaactctgctttttggtaaaagcatctctttcctattcccaggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405774 - DNA, 492 bp, Homo sapiens
  misc_feature (35)..(36): n is a, c, g, or t
cggctgctagaggaccctcataggttcgcaggcgnngccgccgccatgatgatgcagtcaggacgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405775 - DNA, 337 bp, Homo sapiens
gcggccgctgccgccgcgtctccgcctgcctccctgcgccgcgcgctctccagtgccggctctagagggcgctcctgggctagcgtgtagggctggcggcggcggcgctcgggtcacctctgggagcggagtgggggcggagcgagacggaagcagctcaggagacttgaggcgtaggctgcggtccccaaggtgaccgcgccctatgtgggactcgccctaatgcctctgaacctgggtttgaggtaatgacctttctcctaggtctgaaggtcacgggtccgctggaggatgccccctctccactcagaggggtggaggcttaatgctactggtg

SEQ ID NO: 405776 - DNA, 1861 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405777 - DNA, 1378 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtggttcgggtcccttccttcatttaaacggtcgcgcccttatgatcatccaggcaaagactgcttatttacggccc

SEQ ID NO: 405778 - DNA, 2641 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaataaaataaattttgtctgcagtatattttcatataaaaaacaaaaaaaaaaaaaaaaaaaaaaaaaggggggggcgcggccgggattaaaatagtttttttttttttttttttccggtatatttttttttttgtgtgttttaaaacccccgttttttggtaccccgcggtggtgaatcacccttgatatcccggtgacaccagcaacaacttggggtggggttccctggacaaaaggggcttcaggaaacctccgtgatggggagcaacagctggggaaaaagaggagctcctctacaaaagaggcggggccacagagaccttggaagggtccaagaaaaaggtgcccaaaaggggggcccggggaaacttcccccagggtggtaaagtgacacccccggttgagtcgttggacaagtcttatcagatacccacgccctcagaagaagggttttttaaggaccagggtgggagacaacgatagccgagggcccccttggtaccgagggaatatacgtacaccaacactaaagcgagagcagatgtacctcttgaaggggacatgtgtggtgtgccgatttgtgtccccccacaactgcgaccgggaaaaggaacattgcaggaatatgcccgggtggggggaccctgggaggagagtaaagagaggcggccaagacccagagccagtacacacgattttaaaggcgccataggatatcagcaggcagcaggaggaaactgcatgcgacatgtggctggaccacatgcacagtctgacctg

SEQ ID NO: 405779 - DNA, 2090 bp, Homo sapiens
  misc_feature (1864)..(1864): n is a, c, g, or t
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaacanacagcacacaacaccttcctattaacaaccaagggggggggcaaaaagatcccgcggagggcccaatttgcaccccgtttctgtgccagggggcctaggggcggatatagagcggccggcgcggttaccccggcggacacgcctggtctttcgagccccctggttctttggcccccagatgccggaaaactgtttgtgaccgtggcggtgtgcgttatactcttct

SEQ ID NO: 405780 - DNA, 1885 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaacagccaggagtctgtcaagaatgc

SEQ ID NO: 405781 - DNA, 1239 bp, Homo sapiens
  misc_feature (3)..(3): n is a, c, g, or t
  misc_feature (28)..(28): n is a, c, g, or t
atnttcggcacgaggccggtttcccgangttccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405782 - DNA, 1616 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaatggatctgttcccggcgctgagggggaaatgccggataagggcaacttttcggggctggccacgccaacgagggggcgcgcggttatacaaaccaaattcgggtccggagagggtataaatatcagaggggtggaagggagaaaaccagggttcatctaaacacgtagtatata

SEQ ID NO: 405783 - DNA, 1157 bp, Homo sapiens
ggcggagcgagacggaagcagctcaggagacttgaggcgtaggctgcggtccccaaggtgaccgcgccctatgtgggactcgccctaatgcctctgaacctgggtttgaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405784 - DNA, 897 bp, Homo sapiens
tcgacggacgcgtgggtcgacccacgcgtcatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405785 - DNA, 1542 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggcatttgcttcgctccgcccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcagatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaa

SEQ ID NO: 405786 - DNA, 3562 bp, Homo sapiens
ccgaggcgagggagtcccgggatcacagaggagcgggtcccgggttcgagtcgctcttgccctcccgcccgggccccgcgctcactgtccatgccggggaagggcagcggctgcgcccccagctgctgctccaccgcgatctccaagtcaaacttgatgtggtccacgctggcgatgatttcctgcatggcggcggcggcggccccaccggcccggctccccctcggtctcctgcagccttctcgcctttacccgccgccggccccgccgcacacactcctccttcgcttcgcctcgccgccgccgccgccgccgcccgagggatgccgggagcgcccggagcccgcgccggcccttgcgcctgtccaggcactgccaatcgagactccgccgttccgctagtcccagctagccgccagccgaacaccggcctcgccagaaacctgaaaccagccgcgtgagtcggcgacgcggattgcgcctgcgcgcttggggagagggggacccgaggaagagactggttcgccgcggggaccgggcagggctccccgtcggagtgcactgcgccggacacttcaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcacgggacttccagctccagctacctttgtgtgtcacctcacacaccacaagggggctggggcatctggtccctggggcctgggccgccccgccgggttccataggccgatgctctgaaagaagagacgtggggctcgagagatttaaagattttatttttacaaatcacagctgatagacagcgaagccttccccatagagaccgtgctccaactcgggcctggggcactgctcgctgctcccaggaagggggtggcgtgacaggcaggaacctgcgaagtccagagtccagggtggagcgcgccagcctcagccagagcagccacgacagccacagtgtgtgcactcgatgatgcggccctgcaacggaggaggacagtgagacgatgccactgcgccacgctcgcccctgcacactcacatatgtggcaaccctcccacgaaggacctgccaccatgccatatagggacacacctcagaaacccttccttgacagctctggacagggaaaatttggctccctcatgaaggtagaaccagctgctgttgacaccgaggttacatctgtatgtctatttataatatgttctgcaaatccaacacacgtttgccaatcaagaaaaagaaatcggtgtga

SEQ ID NO: 405787 - DNA, 3041 bp, Homo sapiens
ccgaggcgagggagtcccgggatcacagaggagcgggtcccgggttcgagtcgctcttgccctcccgcccgggccccgcgctcactgtccatgccggggaagggcagcggctgcgcccccagctgctgctccaccgcgatctccaagtcaaacttgatgtggtccacgctggcgatgatttcctgcatggcggcggcggcggccccaccggcccggctccccctcggtctcctgcagccttctcgcctttacccgccgccggccccgccgcacacactcctccttcgcttcgcctcgccgccgccgccgccgccgcccgagggatgccgggagcgcccggagcccgcgccggcccttgcgcctgtccaggcactgccaatcgagactccgccgttccgctagtcccagctagccgccagccgaacaccggcctcgccagaaacctgaaaccagccgcgtgagtcggcgacgcggattgcgcctgcgcgcttggggagagggggacccgaggaagagactggttcgccgcggggaccgggcagggctccccgtcggagtgcactgcgccggacacttcaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcacgggacttccagctccagctacctttgtgtgtcacctcacacaccacaagggggctggggcatctggtccctggggcctgggccgccccgccgggttccataggccgatgctctgaaagaagagacgtggggctcgagagatttaaagattttatttttacaaatcacagctgatagacagcgaagccttccccatagagaccgtgctccaactcgggcctggggcactgctcgctgctcccaggaagggggtggcgtgacaggcaggaacctgcgaagtccagagtccagggtggagcgcgccagcctcagccagagcagccacgacagccacagtgtgtgcactcgatgatgcggccctgcaacggaggaggacagtgagacgatgccactgcgccacgctcgcccctgcacactcacatatgtggcaaccctcccacgaaggacctgccaccatgccatatagggacacacctcagaaacccttccttgacagctctggacagggaaaatttggctccctcatgaaggtagaaccagctgctgttgacaccgaggttacatctgtatgtctatttataatatgttctgcaaatccaacacacgtttgccaatcaagaaaaagaaatcggtgtga

SEQ ID NO: 405788 - DNA, 5937 bp, Homo sapiens
ccgaggcgagggagtcccgggatcacagaggagcgggtcccgggttcgagtcgctcttgccctcccgcccgggccccgcgctcactgtccatgccggggaagggcagcggctgcgcccccagctgctgctccaccgcgatctccaagtcaaacttgatgtggtccacgctggcgatgatttcctgcatggcggcggcggcggccccaccggcccggctccccctcggtctcctgcagccttctcgcctttacccgccgccggccccgccgcacacactcctccttcgcttcgcctcgccgccgccgccgccgccgcccgagggatgccgggagcgcccggagcccgcgccggcccttgcgcctgtccaggcactgccaatcgagactccgccgttccgctagtcccagctagccgccagccgaacaccggcctcgccagaaacctgaaaccagccgcgtgagtcggcgacgcggattgcgcctgcgcgcttggggagagggggacccgaggaagagactggttcgccgcggggaccgggcagggctccccgtcggagtgcactgcgccggacacttcaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcacgggacttccagctccagctacctttgtgtgtcacctcacacaccacaagggggctggggcatctggtccctggggcctgggccgccccgccgggttccataggccgatgctctgaaagaagagacgtggggctcgagagatttaaagattttatttttacaaatcacagctgatagacagcgaagccttccccatagagaccgtgctccaactcgggcctggggcactgctcgctgctcccaggaagggggtggcgtgacaggcaggaacctgcgaagtccagagtccagggtggagcgcgccagcctcagccagagcagccacgacagccacagtgtgtgcactcgatgatgcggccctgcaacggaggaggacagtgagacgatgccactgcgccacgctcgcccctgcacactcacatatgtggcaaccctcccacgaaggacctgccaccatgccatatagggacacacctcagaaacccttccttgacagctctggacagggaaaatttggctccctcatgaaggtagaaccagctgctgttgacaccgaggttacatctgtatgtctatttataatatgttctgcaaatccaacacacgtttgccaatcaagaaaaagaaatcggtgtgaatgagtctcgttattctgctaagtgagcatgacagaccctgcgatgagcagacgtggctctgctactgtttggggacttcaggggggcctctgggctggtacactctggtgggggaagagggcaggagactatgcacttgagtcacacccttctggcccagagccccccagaaagaagggtcttgtcccccaggcctggtgcggcccaacacttggccagccagaaagccctagaacagtggcttgtgtttattttactttttcaagttctttttttggaagaacaagaccatagtttaagtaaacaggatcctctggtgaaacccaggtaagtctacagcgggctgttttggccacagggctgaagcagcaccccagcccaccagcccctgacctggactccttgtggaatctgggcactcagaggaagggggcttctgccactctgccacctgtccctgcctccatcagaaaaccaacaccccagtcttccgtcggggaggcggcccttgctcgcccccactgctcagtacccaagtcctcagcatccagccacagctctccattgtcagtctcactgcagcataaaggggactcatgtgaagaggcccctgtgtggagctggggaaaagaaggccaggctggcagatgggcggtggggccaacaactgtgctgaggggctgcactgagcggccactgctgtgactctgcctcgggccacagctgcctttcagaggggcttggaaccggatggagctcagctcctgtccctcagcaccactcctgaggcgcctggcctaggagtggtacttggaacagaaagttctgaaagaagaaacacagtgggctgggcgcagtagctcatgcctgtaatcccggcactttgggaggctgaggcgggtggatcacctgaggtcgggagttcgagaccagcctgagcaacattgagaaaccccgtctctactaaaaatacaaaattagccaggcgtggtggtgcatgcctgtagtcccagctactcaggaggatgaggcaggagaaccgcttgaacccgggaggtggaggttgcagtgagccaagatggcatcactgcactccagcctgggcgacaaagcaagactccgtcttgggggggcgggaaagatagtgatggtaatgttaaagtatcactgtgaggactgaaagggacaggaactcactggttgtccttccctgatgtcaccctgccaccaccttgggattagggctccccaccaccatttcctaagtgaggaaaggggttcagtaatttgcccaaaagtggagttgagattgaccccagacctaacaaacacacagccacacgctgcctcacatggattcctgaatacagggacccactcccacgagggagagccagcaggacatccagggacaaaacgacattccagcccaaccaaataacataagatcccttgcagtcgactaaggcagaattttgagctgaaaacaacaccaagcttgagtgtcagacattaccacttccagcttgcttttgggcacgcggcagatgcagttcgtcccgaagttggtgtcccgtgtctgaatgcaccgcaggcagcacaagttctcatatccttgctttttccattttgcaatcaggtttttgtctgcatagccttctttaatacaatattcatagagttctgtcaaaaagatggggaaagagcatcaggccatggtctaaaaaccttccccacccttgatcaaaaaaagcattcaggccgggtgcagtggctcacacctgtaatcccagcactttgggaggccgaggcaggcggatcacctgaggtcaggagttcaggaccagcccggccaacatggtaaaaccccgtctctactaaaaatacaaaaattactcgggcgtggtagcagctgtaatcccagctacttaggaggctgaggcaggagaatcacttgaacccaggaggcggaggttgtagtgacctgaggtcgtgccactggactccagcctgggtgacagcgaaactccatctcaaaaaaaaaaaggcattcagtattgcaacgggacagtccttggaggaggaacaaaaaaaaaaagtacttaggccaggcaaggtgcctcacacctgtaatcccagcacttttggaagccaacgccagaggatcatttgagttaagaaaccagcctgggccaagggcccatctccacaaaaaatttaaaaattagctgggtgtggtggtgcacacctgtagtcacagctactcaggaggttgaggtgagaggatcccttgagcccagaaggttgaggctgcagtgagccatcattgcaccactgcactccagcctgtggaacagagcaagaccctgtttca

SEQ ID NO: 405789 - DNA, 3338 bp, Homo sapiens
ccgaggcgagggagtcccgggatcacagaggagcgggtcccgggttcgagtcgctcttgccctcccgcccgggccccgcgctcactgtccatgccggggaagggcagcggctgcgcccccagctgctgctccaccgcgatctccaagtcaaacttgatgtggtccacgctggcgatgatttcctgcatggcggcggcggcggccccaccggcccggctccccctcggtctcctgcagccttctcgcctttacccgccgccggccccgccgcacacactcctccttcgcttcgcctcgccgccgccgccgccgccgcccgagggatgccgggagcgcccggagcccgcgccggcccttgcgcctgtccaggcactgccaatcgagactccgccgttccgctagtcccagctagccgccagccgaacaccggcctcgccagaaacctgaaaccagccgcgtgagtcggcgacgcggattgcgcctgcgcgcttggggagagggggacccgaggaagagactggttcgccgcggggaccgggcagggctccccgtcggagtgcactgcgccggacacttcaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcacgggacttccagctccagctacctttgtgtgtcacctcacacaccacaagggggctggggcatctggtccctggggcctgggccgccccgccgggttccatgacagccacagtgtgtgcactcgatgatgcggccctgcaacggaggaggacagtgagacgatgccactgcgccacgctcgcccctgcacactcacatatgtggcaaccctcccacgaaggacctgccaccatgccatatagggacacacctcagaaacccttccttgacagctctggacagggaaaatttggctccctcatgaaggtagaaccagctgctgttgacaccgaggttacatctgtatgtctatttataatatgttctgcaaatccaacacacgtttgccaatcaagaaaaagaaatcggtgtga

SEQ ID NO: 405790 - DNA, 479 bp, Homo sapiens
tttggtacatctgggtgtgtgggctcagttttcagagtcccttcaatgtgtctgagtttggagagctgggctctgatgtgtccatggctctgccttagagcctggcctggtggatgcagtgacggggtcctctccagcctcagcctcctctggggcagctgctcacctgtgcgtccagctgatcccgggccaccactgagcttcttccatctccacagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggtggggcttcccctgccgtcctgctccccttcatggggctgg

SEQ ID NO: 405791 - DNA, 2672 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 405792 - DNA, 1080 bp, Homo sapiens
agtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaa

SEQ ID NO: 405793 - DNA, 5379 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405794 - DNA, 5508 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405795 - DNA, 4861 bp, Homo sapiens
  misc_feature (145)..(145): n is a, c, g, or t
actacatacttccgtcagtgttagaaaccttttatcttttccttcctcatgctactcttctaagtcttcatatgttctcttaaaatcttaagctattaaaattacgttaaaaacttaacgctaagcaatatcttagtaacctatngactatattttttaagtagttgtattaatctctatctttcaaagagaaaaaaacttatctgcggtttcctcaagctccgcctgccccctcagcagaagcccctgcgctggctgcctcaatgcctcggaagtatgtagtctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405796 - DNA, 5019 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405797 - DNA, 4758 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405798 - DNA, 4559 bp, Homo sapiens
ttcttcatgttcccttattattccactatgatcagttgtcaaaggcagaaccacaaaccattcaaacatattcatttttatcatgaagcaacataaaaaatcctgtgcccacatggtataatagataaatgactcctaaatgcaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405799 - DNA, 4884 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405800 - DNA, 4155 bp, Homo sapiens
tgctcctttcactggaggagccgctgctcacgtcagcacttcaggaggttacatcttttacaccttttctactgtacaccccatcccagacgaagacagtccctggatcaccgacagcacagacagaatccctgctaccacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405801 - DNA, 5361 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405802 - DNA, 4566 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405803 - DNA, 5325 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgatggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405804 - DNA, 5755 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaaaaaaaaaaaaaaaaaaaaaaaaaaaaaaaaaaaaaaaaaaaaaaaaaaacttagtcattgtggaagtatggcatgggtcaagaagtacttctccttcatcttcctttgatgtcggtaactcatcctttctgcactgcgggagttgttaatgcttttgggtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccagcgtccattaacacttgacattgctcactgcatggtcacag

SEQ ID NO: 405805 - DNA, 5376 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttagcgcgtgctgtccggacagcacgcgctaacaaatggtcagtagatgctggacacaatcattagggaagtgtaaatcaaaactactatgagctcgggtgtagtggctcatgcttgtaatcccgtactttaggaggctgtggtagctggactcaccttgaggtcccggagctcagaacagcctgt

SEQ ID NO: 405806 - DNA, 5325 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405807 - DNA, 3247 bp, Homo sapiens
ccattcgagagttccccgggtgggagtacggaatgcacagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405808 - DNA, 3714 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405809 - DNA, 1072 bp, Homo sapiens
gttgcttttcagttaaagagcttgagtgagcctgtctgggcctctggcagacccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405810 - DNA, 2446 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 405811 - DNA, 2722 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacaggggagccggagcacactacaacgcatgccactgtggctaccgatagaccccctgcccacctcaccaacaccaatcacacaataccccaccccaaaacggaacaacgcagcacggccaccaaaagcagctcacctgacacacacacgcacggacaagtacggaacaaacacggcccacaataactcaccaaccaagaattgcaaccaccacgaacccactcaggaagcatcaacaccggaggcgcaagagcgggcctaaagaccacccaccatgttcccgcaagcaaagtcacaacaagaaggccacccacggaaacagacgccggagcaccaacgaggccccaccacagaaacccga

SEQ ID NO: 405812 - DNA, 2603 bp, Homo sapiens
  misc_feature (2439)..(2439): n is a, c, g, or t
  misc_feature (2461)..(2461): n is a, c, g, or t
  misc_feature (2464)..(2464): n is a, c, g, or t
  misc_feature (2504)..(2504): n is a, c, g, or t
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagtaggactcactactggcctctctatcttttatacgtattctttctcaattttcctatcatgcaaaacagtaaaaaatctcaacacattcacacctgattctggttacccagtagtattacttgtgtgcaattaaacaagagaccaaaaccacagaacaagtgcacgtggtagggattacagggtagggaacagatataaaaacacagatgtgcagatttcaccagaaacctcaaggatccacatcncacgtctggggcagagggctantgnccaggttagtccgcttcacccatcactcctattcttgacnccaaagcaggccactgcttttactgttgacctgggtcctcaaatgagtgtgtgaaagtccataatgcatctggtgaaacagatgacgcacaacctacag

SEQ ID NO: 405813 - DNA, 3049 bp, Homo sapiens
  misc_feature (2229)..(2229): n is a, c, g, or t
  misc_feature (2243)..(2243): n is a, c, g, or t
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaagttgaagagattcaggttatagcataagaagagcactgtttcatcgtcttcttgctgttaggaggtctatgaagcagagaagaactttcctttggaaaacaactaaatgaagacagtcacctcnctagaactgacacntgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacacttaagatacattattttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcct

SEQ ID NO: 405814 - DNA, 2129 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtaaggggctgtcctgggggctt

SEQ ID NO: 405815 - DNA, 2739 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttcagg

SEQ ID NO: 405816 - DNA, 2161 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagaccaaactactttcctgaaggacctgaggttcttcaaaaattagttttcttggtaggagtgatactcatattcacctgaatatgaagttctgagctgaaagtaaggaatttagcaggagggttggcaaaagaaaaaacttattgtcaaaatatatctgtgtgaggcagtaagtaatagatatgaaatgaatgttgccaacaataaacgctaaagaaattctgagaacccctccctgcccaccacag

SEQ ID NO: 405817 - DNA, 910 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagca

SEQ ID NO: 405818 - DNA, 1175 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaa

SEQ ID NO: 405819 - DNA, 1078 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatccaggcaactcctagtagtacaacggaagaaacagctacccagaaggaacagtggtttggcaacagatggcatgagggatatcgccaaacacccagtgtctccaggttcatctacatgcatgaataccatgtcatcatttgctccagaatagaatagaactgttcctgtccacgaagggggatgacacgggatcgctctagt

SEQ ID NO: 405820 - DNA, 915 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccactgggtagaatatgtgtcttggtctctggtagcagggattctgtctgtgctgtcggtgatccagggactgtcttcgtctgggatggggtggtcgacg

SEQ ID NO: 405821 - DNA, 511 bp, Homo sapiens
tgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaacagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaa

SEQ ID NO: 405822 - DNA, 463 bp, Homo sapiens
gtatgggttcatagaagggcacgtggtgattccccggatccaccccaactccatctgtgcagcaaacaacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcac

SEQ ID NO: 405823 - DNA, 376 bp, Homo sapiens
gcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacg

SEQ ID NO: 405824 - DNA, 1188 bp, Homo sapiens
tgctcctttcactggaggagccgctgctcacgtcagcacttcaggaggttacatcttttacaccttttctactgtacaccccatcccagacgaagacagtccctggatcaccgacagcacagacagaatccctgctaccacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttcagg

SEQ ID NO: 405825 - DNA, 599 bp, Homo sapiens
actctggcatacttgtcctatgatgtacccctggatacacctggataggagctatccaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtaaggggctgtcctgggggctt

SEQ ID NO: 405826 - DNA, 6754 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405827 - DNA, 5355 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccacaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405828 - DNA, 5706 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405829 - DNA, 6259 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405830 - DNA, 5013 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405831 - DNA, 4362 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405832 - DNA, 5502 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaaca

SEQ ID NO: 405833 - DNA, 6098 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaagaacaaaaagagaacaacaaaaaagaaaaagaaaaagagcagaacaaaagaaaaagagaaacaagagcgaaaacagaaaaacaacagaagagaccgagaagcaaacaagcagacgcgagaaacaaaacgaagaaaagagcagcgacccacacgacaaaaagagcgaggactgcgcaacaagggacagacacaatagaaaaagaggaagcaagacaaacggagagagaaagaaagaagaagaaagatggagaaacacgaaacacagagagatcgaaggagcagagaacgaagaaagaaagaaagaaagaagacaaactagaggcacagcaaatgaggacagagaaagaaagagaaaagagcgcagagaccagacgaggcacggcgaacacggacaggacaacaagaccggaaggaagcagatgaggcgcggggggacgagggagcgaccggagagggaggagaacgcacgaagcgagacgaaaccagaggcgacggcggaagagggacacgagacacggcacggaagaggggacgagggaggagagaagaaggggatagcaaggacgacgcagaaaacaagaaagactaaccggacaact

SEQ ID NO: 405834 - DNA, 5722 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaaaaaaaaaaaaaaaaaacttagtcattgtggaagtatggcatgggtcaagaagtacttctccttcatcttcctttgatgtcggtaactcatcctttctgcactgcgggagttgttaatgcttttgggtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccagcgtccattaacacttgacattgctcactgcatggtcacag

SEQ ID NO: 405835 - DNA, 5089 bp, Homo sapiens
  misc_feature (5011)..(5011): n is a, c, g, or t
  misc_feature (5014)..(5014): n is a, c, g, or t
  misc_feature (5017)..(5018): n is a, c, g, or t
  misc_feature (5023)..(5023): n is a, c, g, or t
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttttgggattctacaccccgaattgtttgggcccctnctnccnngcttnccggggcggggaccttgtctttgggagcacgtttataaaatggcgcccttgtatctcgtgcaacgg

SEQ ID NO: 405836 - DNA, 3359 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaataaaaaaaaaaaaaaaaaaaaaaaaaaaaaaaaaaaaaaaaaaaaaaaaaacttagtcattgtggaagtatggcatgggtcaagaagtacttctccttcatcttcctttgatgtcggtaactcatcctttctgcactgcgggagttgttaatgcttttgggtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccagcgtccattaacacttgacattgctcactgcatggtcacag

SEQ ID NO: 405837 - DNA, 1429 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 405838 - DNA, 1705 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacaggggagccggagcacactacaacgcatgccactgtggctaccgatagaccccctgcccacctcaccaacaccaatcacacaataccccaccccaaaacggaacaacgcagcacggccaccaaaagcagctcacctgacacacacacgcacggacaagtacggaacaaacacggcccacaataactcaccaaccaagaattgcaaccaccacgaacccactcaggaagcatcaacaccggaggcgcaagagcgggcctaaagaccacccaccatgttcccgcaagcaaagtcacaacaagaaggccacccacggaaacagacgccggagcaccaacgaggccccaccacagaaacccga

SEQ ID NO: 405839 - DNA, 2217 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggatgttatcgcccaacacgaagggtgatggggtccagggtggccctctgcagaagctgcaggtacgtgaggttctcgtgcgtgttggggataacatcaggtaccgagccga

SEQ ID NO: 405840 - DNA, 2624 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaa

SEQ ID NO: 405841 - DNA, 1036 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtacaacgcttcagcctactgcaaatccaaacacaggtttggtggaagatttggacaggacaggacctctttcaatgacaacgcagcagagtaattctcagagcttctctacatcagagagagctgcaggtacagagctcgat

SEQ ID NO: 405842 - DNA, 1187 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttacgaagggggatgtacacacgaaggggatgacacgaaatcctgct

SEQ ID NO: 405843 - DNA, 1145 bp, Homo sapiens
ggttttttgtgtgttgtttgtgtgccggactgatgtccaaagttccgccaggagggctttattgttgtcgttgttcaacatcctgttctgcggcttcctggctctttttgcccgttatgccgaagagccgggcgttggcacggccaatacggagactagcgaaggctttgaaattcttctcttcctcagtgatgactcgagctttctccttctatagacgttccggacgggcatgaccggtccggtcagctgggtggccagtttcagttcttcagcagaactgtctcccttcttgggggccgagggcttcctggggaagaggatgagtttggagcggtactccttcagccgctgcacgttggcctgcagggactccgtggacttgttccgcctcctcggatccacagaaatgccgatggtccgggccaccttcttgtgaatgtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctc

SEQ ID NO: 405844 - DNA, 185 bp, Homo sapiens
ccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccagtaagaataatcaattacagtacagccatttatg

SEQ ID NO: 405845 - DNA, 1862 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405846 - DNA, 895 bp, Homo sapiens
ctccggcgtttgcagcccacttcccgcgcacttggctgtgccattgaggcgttaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaagttcgtgtttagtaggagcacagtagctgtttggggaacgaccttaagtgaatagatgtctgaaatgctgtgtgaagtggggcgcttaataggtgtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggtgagttatcctgctgttggttgtcct

SEQ ID NO: 405847 - DNA, 1716 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405848 - DNA, 2490 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaaggtacagactgctgaggaggaccatccaaggggctgcccttctcactgctctaggcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaattctaaaaagaatgaagttagtttctaaccctaaaaaaaaat

SEQ ID NO: 405849 - DNA, 1989 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcaggtactgcccacagtcccacctgccttctgcgctcccctcccctgactcctgccctccccactgcccagtttattccacttccctgtcctcttccaaaggcctcagagcctttcttctctccctgcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405850 - DNA, 1805 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggagtcctgccaagcccagaagttgtgctcttggccttgcgtgctcatctcggaggcggcagcaacacttcgctttggcttgaatttcagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405851 - DNA, 2237 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggaaaaaaaaaaaaaaaaaaaaaaaaaaaaaaaaaaaaaaaaaggggggggccgacacaaagagagtctcgcgaggggggcggccaagtataaagcgagatacacagaggggctcggtgaccaaaggtggccccaaataggggagaccccgaataaaagcgactcagggcacgtggcccaggcggataacacacgactatagagacggggaaacactgtgtacagcgagggaagccacacgggggcagaaggggaccacccactaagactgctggggggggaggggggaaccacatattgtgtggggcaaaaagatgttatcctaacaaaggagaagaatatttaaagccgcccctcatggagcgcgaaaattttataaaaaagtttaacagaagcgctataccacggctgggtaaacaagcctagagcggtgatataatggttaagtacataaattagaagaaaattggtcgctatacgccggggatatgaactatgaggagacgagttttttcttcacgaga

SEQ ID NO: 405852 - DNA, 2450 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggtgatacgggcatgaaaaccaggcttgaggacatcacaaccccaaggggctgtgcctccttccaggagtcctgccaagcccagaagttgtgctcttggccttgcgtgctcatgtttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaattctaaaaagaatgaagttagtttctaaccctaaaaaaaaat

SEQ ID NO: 405853 - DNA, 1484 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405854 - DNA, 313 bp, Homo sapiens
agagggcagagccatgctcgttcttgctatcctgagattggttgctatctgtttcctttgctgctgtgtttttttctgtcagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcaggtactgcccacagtcccacctgccttctgcgctcccctc

SEQ ID NO: 405855 - DNA, 289 bp, Homo sapiens
ctccggcgtttgcagcccacttcccgcgcacttggctgtgccattgaggcgttaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaaggtgtgagcgcagggtacagaaatgctggctccaggtttgac

SEQ ID NO: 405856 - DNA, 2436 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaattctaaaaagaatgaagttagtttctaaccctaaaaaaaaat

SEQ ID NO: 405857 - DNA, 1770 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaaggtacagactgctgaggaggaccatccaaggggctgcccttctcactgctctaggcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405858 - DNA, 1727 bp, Homo sapiens
ctccggcgtttgcagcccacttcccgcgcacttggctgtgccattgaggcgttaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405859 - DNA, 1604 bp, Homo sapiens
ctggggagacacacatgctcattctcgagggtggcggtggtgcagagggcagagccatgctcgttcttgctatcctgagattggttgctatctgtttcctttgctgctgtgtttttttctgtcagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaggga

SEQ ID NO: 405860 - DNA, 2358 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgattattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggtgatacgggcatgaaaaccaggcttgaggacatcacaaccccaaggggctgtgcctccttccaggagtcctgccaagcccagaagttgtgctcttggccttgcgtgctcatgtttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaaggtacagactgctgaggaggaccatccaaggggctgcccttctcactgctctaggcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaattctaaaaagaatgaagttagtttctaaccctaaaaaaaaat

SEQ ID NO: 405861 - DNA, 3099 bp, Homo sapiens
gagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaa

SEQ ID NO: 405862 - DNA, 520 bp, Homo sapiens
ataggaatgttcgggtgactactgattaatgtagtgaagatgatctgtcacttgccagaccaacaggagttggaaagagaaacctagccatggtgtctgccacagagggaccctctaaagtgctaggaggagggtggggggcagtcgccacctgtgggatgccatgaacagcctctgcaactggccagcaccaggaaggggggcctcctggtggtggagttggagtcctttctggctgaatgaggagcaatgtggctggggtgtgcgggtttctggtgaggtccgggtgggaagccgtctctccgcattctcctgaaagctctgttgtagtttgaaggtcggtagagccttttttcgcctctgtggacacccttttgaaattttttcttccaattgacttggatctcctctggattttttttccctctttcccccgtcggactcttaaataaaagtgagcaagtccaaagcgtggtccggagagcgtggacaaggtaacctgttttggatgtccgggaga

SEQ ID NO: 405863 - DNA, 3270 bp, Homo sapiens
  misc_feature (538)..(539): n is a, c, g, or t
gagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggcgccanntgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaa

SEQ ID NO: 405864 - DNA, 3018 bp, Homo sapiens
gagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaa

SEQ ID NO: 405865 - DNA, 3274 bp, Homo sapiens
ataggaatgttcgggtgactactgattaatgtagtgaagatgatctgtcacttgccagaccaacaggagttggaaagagaaacctagccatggtgtctgccacagagggaccctctaaagtgctaggaggagggtggggggcagtcgccacctgtgggatgccatgaacagcctctgcaactggccagcaccaggaaggggggcctcctggtggtggagttggagtcctttctggctgaatgaggagcaatgtggctggggtgtgcgggtttctggtgaggtccgggtgggaagccgtctctccgcattctcctgaaagctctgttgtagtttgaaggtcggtagagccttttttcgcctctgtggacacccttttgaaattttttcttccaattgacttggatctcctctggattttttttccctctttcccccgtcggactcttaaataaaagtgagcaagtccaaagcgtggtccggagagcgtggacaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaa

SEQ ID NO: 405866 - DNA, 1793 bp, Homo sapiens
acggcattgcccaggctctgccgtggaagtcaaattgttgaagcatatctttgccgtgcacttggtcataaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaa

SEQ ID NO: 405867 - DNA, 940 bp, Homo sapiens
gagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcaggtaattcgagaaccaggctgcctgggcgccattcacttccccactctctgggggggcagggagcatctaaacctttatctgatactctattccctgtggaattgcaaaatggagaaagctgcacgccagccgggagtggtggctcgcgcctgtaatcccagcactttgagaggccaagacgggtgaatcacttgtcaggagttcaagaccagcctagccaacgtggtgaaacctcatctctactaaaaaaaaaa

SEQ ID NO: 405868 - DNA, 1016 bp, Homo sapiens
gagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgtgggctataaataaaactcccaacgagcaatcctccccgattgagtgtcaagaaaaccctcttttgaatcagccggaaaggagctggggcataaactgatttgggcccacaaaaggcc

SEQ ID NO: 405869 - DNA, 3045 bp, Homo sapiens
gagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaa

SEQ ID NO: 405870 - DNA, 2102 bp, Homo sapiens
cccactagttacccaccccaaactggatcctacagccaagctccaagtcaatatagccaacagagcagcagctacgggcagcagaatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaa

SEQ ID NO: 405871 - DNA, 2338 bp, Homo sapiens
gagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactgtacattatctgatgccattaagcgttatccaacttcactgtcatgaaacacgattttcctttataacccaagactttcataatcctctatcgacacattcactcacgtaccctcttctacactacgaacattaactacaactttattcattcactcttcctaaatacatgaattaatactacctctatttcttaaatatacatagcccaaccttaaaccgtcggcttctaactaaccactcct

SEQ ID NO: 405872 - DNA, 603 bp, Homo sapiens
agagaaagtcgacatgttctcgcaggctgccgggcgtcccggggttgcctcttgcctgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggcatttatgacattaacagagaacaggactatgtcaagaattctgagggtatacttggtgaaaatgaattaagaccaccctcccagctacattctctcttagagaagatcgagacagggtccctatcagaaaagatttttgagacagtgtccttgagttcagactctctcttccagagggcagtttcactcctccatacttcttacttggactcttcatctgagcatggttttcagtacagtcaagtgactttggtgaaaaatgacattttcttaaatgaggtgaggtgct

SEQ ID NO: 405873 - DNA, 797 bp, Homo sapiens
caaagtggaatattatttggcataaaaaggtatgaaatattgatatatgctttaacatggatgaacttcaaaaacaggctaagtgaaagaagccaatcatgaaggaccgcgtgctgtatgactctgtttataggaaatggtctggaataggcaaatctgtagagaccgaaagtaaattatggtttcctaggcctaggaaccagtgaggggtgaggaggatagctaaggggtagaaggtttctttggggataatgaaaatactctaaaattgattgtggtgaaggttgcacaattctgtggatatactaagcacaattctgtggatatactaaaagcaattgaattgtacactttatgtgggtgaattgtatgccgtatgaattatatctcaacattgtattagaaaataaaattaatgaagcatagaagttacggagaactactggaaagaagaaatacaagaactcaaggaagagacagccagacaacagtagagtgtgaaatgggaaccagcagaaaaaaagaaatagagaaaaatgatcaagccatttcagaagtacacaagggagactagacaccatggcaaagatcataaaagtagaaatgaaattttatggtaagtatattttaccacaattttgataatgcaaagaaagaaaacaaaagatagacaggagaaaaatgagtaaaacaggtacacatttatttttattgatgcgtaatagatgtacacagttttaggatacatgtgataatacagtcatataatttgtagagatcaagtcagtgtagttggg

SEQ ID NO: 405874 - DNA, 607 bp, Homo sapiens
tttttgtatttttagtagagacggggtttcaccgagttagccaggatggtctccatctcctgaccttctgatccacccgcctcagcctcccaaagttgctgggattacaggcgtgagccaccgtgcctggcaaataactcataaatagcataattttttttaattccttattcctgtatacataatttttttgacacatctagatactttgtctgtactgaaaatacatgtattgagaagatgtgaacatatttgcagaccatggtttatgggtcatatatttgaaaatctgtactacttaaaaatacacatattatttaacctggagcttatcaacttaaggtcttttttgtggttatatttttgtttacatttatattagaaaaccaaaacttaagaaaatttagatccactgtttattattctgcttgatactgttgtgttgtttttcagaccgcaggaactagattttaaatatgtaatgaaagtgtcttccttgaaaaaaagactaccagaggctgccttcagaaaacagaattacttggaggagaaattttctgctctcttccaaacactcacacatgcacacttctgtttcatcataagt

SEQ ID NO: 405875 - DNA, 1758 bp, Homo sapiens
agagaaagtcgacatgttctcgcaggctgccgggcgtcccggggttgcctcttgcctgtgaccctgacgggagacagagcgcgggcggccgcggcgtccctgtcagcgcccgcggcgaggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgagcggcaggcaaaattggtatgtcagtgtggactccgtgttggcagcagtgctgttaccactctgggtgatccagccaaaggtgtatacatttccaaatactccgactgtcttcattcaagaccatggtatcatgggaaatctggttatgttgtaatttttaatataattaaggtaaagcttaaatgtgctgttacgtgatttccttttaaagtttaaggttatctacctttgatattctctgtagatattagttgaacatagttctcaccaaagttagctatccaaattcaggaaaagcaaaactatttttccttttctttaaaaagaaaactttgattcatttactagattgtaaacttttttttaacttcaaaaataataaaagggtatgcagggaaaaatcttcctctcacctgtcagagctactttttaaatatgaaataagagaaaacaagtagctgcttataaggtgatgtgattacacttataaaagatgaatttagaaaacaacattcattgtctaatttaaatggtcaatagaatctttattttctttctccataagacatccagcttcacagcttcatgtgctacctagaactgatgatgccacaaatccttaaatgtcctaaatggtactgttaagtgaatcgtgcaattagaattttcacccaaacagaagggaaactgattttagatgtgattgggcttcttgaggacatttctgtggtctcgttttattgtttttttttttagctttgttactatcttaaattctttggttatcagcctagcactaaatgacctttaattaaaaaaaaaaaaaaacaagagcctgtgaattcttaatattgtaaagtttgttcccaaagtgctgggttacagttgtgagccactgtgcccagctgcttgcttttttctttttttttggagagacatgtaacccttgatggagagaactctgtaatggaaaatactgctgactgttcagcaaccaggaccagctgcctgctaagaactttgctacatatttgctccttgttaacttgctgggccctgtcataatagaagtatctcagtttataatttacaactgatcatagttcagattggaaactcatcttttgaaattttagattttgtcctcttttacattacagtcaccaaagagccattcagtgaccgtaacataaaagatggtgggctatagtttttcttttaaggaaatggctctcttaaatttagggtgattcgtatatttctttgatattgtgataaaaactatggatatttgtctcagacgcccaaatgtccaaaatttttgagtccatttttaagggttcatggataatcaaaactatttttggccttaagataattgttttctaagaagtatagttcttaatacagttactgttaggggacacatatctgcatccttgttagactacttctaaatgaatcctagagtaaaggttatt

SEQ ID NO: 405876 - DNA, 1089 bp, Homo sapiens
taacatttatactatatgaccagtacttccagtgctatataaatcattctcttctccttattgtttataaatactaggtttgtaaaaccccccaaccttaataaagagaatagaaagagtacaaataggagagtgaacagttaaaatggttagatgcaagagtgtccgtaggtcattaggctcagttcttgctaaagtagagacttgtaaaatcaaaaggcacaaagagtcagtcaacataattactggatccagtcggtaattctcaattaggaaacgtgcctctcatgggaagggtgtatcacagtccctcaaagctatctcacatgggtatggtttgaaaaaagcaccttcaaaaaattgtaagtgcagctctgttgtataaaatgaaagaaagtgattttataatacaactcacaggaagtaaaactcaatagactcttcttgacgggtgaggaaatcccagagatacaatgatttctattgtgtctggtgagtgggcaatagtaggtcccttaaaaggaacctagctgacttagggatttaatgaaaatatgtaaagagtaagtttatcaagtgtggcgtatatatttaaaaaaaaaagaatagaaacaaaggatgaaaaaaactaaagaatgagaaattgctctaaaagtctaagcagctcctgaccaccaccttgacactacagttgtatccacttttgaccaactacagttatagtacacagctttcaaccaaaagacataccaggtctggcaggacatattttagctcctgtaaggtcttttaaattttgttaagacagtacaaatatttcttagttatataggaaaggaataggtgatgttttgagtgatattcagtgtgtctcccttaaccccatcctttggaatcttaaatagctgcgttatttttgtttgtgttttacagtttttgagacagtgtccttgagttcagactctctcttccagagggcagtttcactcctccatacttcttacttggactcttcatctgagcatggttttcagtacagtcaagtgactttggtgaaaaatgacattttcttaaatgaggtgaggtgct

SEQ ID NO: 405877 - DNA, 2321 bp, Homo sapiens
caaagtggaatattatttggcataaaaaggtatgaaatattgatatatgctttaacatggatgaacttcaaaaacaggctaagtgaaagaagccaatcatgaaggaccgcgtgctgtatgactctgtttataggaaatggtctggaataggcaaatctgtagagaccgaaagtaaattatggtttcctaggcctaggaaccagtgaggggtgaggaggatagctaaggggtagaaggtttctttggggataatgaaaatactctaaaattgattgtggtgaaggttgcacaattctgtggatatactaagcacaattctgtggatatactaaaagcaattgaattgtacactttatgtgggtgaattgtatgccgtatgaattatatctcaacattgtattagaaaataaaattaatgaagcatagaagttacggagaactactggaaagaagaaatacaagaactcaaggaagagacagccagacaacagtagagtgtgaaatgggaaccagcagaaaaaaagaaatagagaaaaatgatcaagccatttcagaagtacacaagggagactagacaccatggcaaagatcataaaagtagaaatgaaattttatgcatttatgacattaacagagaacaggactatgtcaagaattctgagggtatacttggtgaaaatgaattaagaccaccctcccagctacattctctcttagagaagatcgagacagggtccctatcagaaaagatacaaaactttttaccaacaaaaaaaagcaagtagttatactcaggaagaacttcaagacacttacgggtttcttctgtttgatactgagcggcaggcaaaattggtatgtcagtgtggactccgtgttggcagcagtgctgttaccactctgggtgatccagccaaaggtgtatacatttccaaatactccgactgtcttcattcaagaccatggtatcatgggaaatctggttatgttgtaatttttaatataattaaggtaaagcttaaatgtgctgttacgtgatttccttttaaagtttaaggttatctacctttgatattctctgtagatattagttgaacatagttctcaccaaagttagctatccaaattcaggaaaagcaaaactatttttccttttctttaaaaagaaaactttgattcatttactagattgtaaacttttttttaacttcaaaaataataaaagggtatgcagggaaaaatcttcctctcacctgtcagagctactttttaaatatgaaataagagaaaacaagtagctgcttataaggtgatgtgattacacttataaaagatgaatttagaaaacaacattcattgtctaatttaaatggtcaatagaatctttattttctttctccataagacatccagcttcacagcttcatgtgctacctagaactgatgatgccacaaatccttaaatgtcctaaatggtactgttaagtgaatcgtgcaattagaattttcacccaaacagaagggaaactgattttagatgtgattgggcttcttgaggacatttctgtggtctcgttttattgtttttttttttagctttgttactatcttaaattctttggttatcagcctagcactaaatgacctttaattaaaaaaaaaaaaaaacaagagcctgtgaattcttaatattgtaaagtttgttcccaaagtgctgggttacagttgtgagccactgtgcccagctgcttgcttttttctttttttttggagagacatgtaacccttgatggagagaactctgtaatggaaaatactgctgactgttcagcaaccaggaccagctgcctgctaagaactttgctacatatttgctccttgttaacttgctgggccctgtcataatagaagtatctcagtttataatttacaactgatcatagttcagattggaaactcatcttttgaaattttagattttgtcctcttttacattacagtcaccaaagagccattcagtgaccgtaacataaaagatggtgggctatagtttttcttttaaggaaatggctctcttaaatttagggtgattcgtatatttctttgatattgtgataaaaactatggatatttgtctcagacgcccaaatgtccaaaatttttgagtccatttttaagggttcatggataatcaaaactatttttggccttaagataattgttttctaagaagtatagttcttaatacagttactgttaggggacacatatctgcatccttgttagactacttctaaatgaatcctagagtaaaggttatt

SEQ ID NO: 405878 - DNA, 1884 bp, Homo sapiens
agagaaagtcgacatgttctcgcaggctgccgggcgtcccggggttgcctcttgcctgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgagcggcaggcaaaattggtatgtcagtgtggactccgtgttggcagcagtgctgttaccactctgggtgatccagccaaaggtgtatacatttccaaatactccgactgtcttcattcaagaccatggtatcatgggaaatctggttatgttgtaatttttaatataattaaggtaaagcttaaatgtgctgttacgtgatttccttttaaagtttaaggttatctacctttgatattctctgtagatattagttgaacatagttctcaccaaagttagctatccaaattcaggaaaagcaaaactatttttccttttctttaaaaagaaaactttgattcatttactagattgtaaacttttttttaacttcaaaaataataaaagggtatgcagggaaaaatcttcctctcacctgtcagagctactttttaaatatgaaataagagaaaacaagtagctgcttataaggtgatgtgattacacttataaaagatgaatttagaaaacaacattcattgtctaatttaaatggtcaatagaatctttattttctttctccataagacatccagcttcacagcttcatgtgctacctagaactgatgatgccacaaatccttaaatgtcctaaatggtactgttaagtgaatcgtgcaattagaattttcacccaaacagaagggaaactgattttagatgtgattgggcttcttgaggacatttctgtggtctcgttttattgtttttttttttagctttgttactatcttaaattctttggttatcagcctagcactaaatgacctttaattaaaaaaaaaaaaaaacaagagcctgtgaattcttaatattgtaaagtttgttcccaaagtgctgggttacagttgtgagccactgtgcccagctgcttgcttttttctttttttttggagagacatgtaacccttgatggagagaactctgtaatggaaaatactgctgactgttcagcaaccaggaccagctgcctgctaagaactttgctacatatttgctccttgttaacttgctgggccctgtcataatagaagtatctcagtttataatttacaactgatcatagttcagattggaaactcatcttttgaaattttagattttgtcctcttttacattacagtcaccaaagagccattcagtgaccgtaacataaaagatggtgggctatagtttttcttttaaggaaatggctctcttaaatttagggtgattcgtatatttctttgatattgtgataaaaactatggatatttgtctcagacgcccaaatgtccaaaatttttgagtccatttttaagggttcatggataatcaaaactatttttggccttaagataattgttttctaagaagtatagttcttaatacagttactgttaggggacacatatctgcatccttgttagactacttctaaatgaatcctagagtaaaggttatt

SEQ ID NO: 405879 - DNA, 884 bp, Homo sapiens
agagaaagtcgacatgttctcgcaggctgccgggcgtcccggggttgcctcttgcctgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgagcggcaggcaaaattggtatgtcagtgtggactccgtgttggcagcagtgctgttaccactctgggtgatccagccaaagtattacttttacgaactttcaggcaacaccgttattgaacgacccagacagatctgtccttatgtaattgtagcttttcgatacagggaatctaaaactatggcaccaccagctcataaaagcatacttgaacgcagtgaaaatgttctcatgtctccatggaaagggaaattaattgttcaagaccgtatgctatgtgatatagctctttggtccacttacggtgcaatgattccaacacagctaccgcaggaactagattttaaatatgtaatgaaagtgtcttccttgaaaaaaagactaccagaggctgccttcagaaaacagaattacttggaggagaatctgttttcaagatttgtgcttcaatttgtatgaggtagaactgtcaaacagacaagg

SEQ ID NO: 405880 - DNA, 730 bp, Homo sapiens
aaatatatacgccacacttgataaacttactctttacatgattttataatacaactcacaggaagtaaaactcaatagactcttcttgacgggtgaggaaatcccagagatacaatgatttctattgtgtctggtgagtgggcaatagtaggtcccttaaaaggaacctagctgacttagggatttaatgaaaatatgtaaagagtaagtttatcaagtgtggcgtatatatttaaaaaaaaaagaatagaaacaaaggatgaaaaaaactaaagaatgagaaattgctctaaaagtctaagcagctcctgaccaccaccttgacactacagttgtatccacttttgaccaactacagttatagtacacagctttcaaccaaaagacataccaggtctggcaggacatattttagctcctgtaaggtcttttaaattttgttaagacagtacaaatatttcttagttatataggaaaggaataggtgatgttttgagtgatattcagtgtgtctcccttaaccccatcctttggaatcttaaatagctgcgttatttttgtttgtgttttacagtttttgagacagtgtccttgagttcagactctctcttccagagggcagtttcactcctccatacttcttacttggactcttcatctgagcatggttttcagtacagtcaagtgactttggtgaaaaatgacattttcttaaatgaggtgaggtgct

SEQ ID NO: 405881 - DNA, 282 bp, Homo sapiens
tttttttgcccccccctccccttttcttttcctttggccgcgaggttttgcttccggttgctagcgccggtcagagagaaagtcgacatgttctcgcaggctgccgggcgtcccggggttgcctcttgcctgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccgg

SEQ ID NO: 405882 - DNA, 465 bp, Homo sapiens
agagaaagtcgacatgttctcgcaggctgccgggcgtcccggggttgcctcttgcctgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacgggtaagtccctcctcggcctgggcgcccgggaaccctgcgaggaggacggcgggtccccgaggccgagcgctcgggcagctgccggggcttggctgcgagggtcgacgcgttctccttgccttttgccgcgctccgggtgagggggtgggagg

SEQ ID NO: 405883 - DNA, 2018 bp, Homo sapiens
agagaaagtcgacatgttctcgcaggctgccgggcgtcccggggttgcctcttgcctgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggcatttatgacattaacagagaacaggactatgtcaagaattctgagggtatacttggtgaaaatgaattaagaccaccctcccagctacattctctcttagagaagatcgagacagggtccctatcagaaaagatacaaaactttttaccaacaaaaaaaagcaagtagttatactcaggaagaacttcaagacacttacgggtttcttctgtttgatactgagcggcaggcaaaattggtatgtcagtgtggactccgtgttggcagcagtgctgttaccactctgggtgatccagccaaaggtgtatacatttccaaatactccgactgtcttcattcaagaccatggtatcatgggaaatctggttatgttgtaatttttaatataattaaggtaaagcttaaatgtgctgttacgtgatttccttttaaagtttaaggttatctacctttgatattctctgtagatattagttgaacatagttctcaccaaagttagctatccaaattcaggaaaagcaaaactatttttccttttctttaaaaagaaaactttgattcatttactagattgtaaacttttttttaacttcaaaaataataaaagggtatgcagggaaaaatcttcctctcacctgtcagagctactttttaaatatgaaataagagaaaacaagtagctgcttataaggtgatgtgattacacttataaaagatgaatttagaaaacaacattcattgtctaatttaaatggtcaatagaatctttattttctttctccataagacatccagcttcacagcttcatgtgctacctagaactgatgatgccacaaatccttaaatgtcctaaatggtactgttaagtgaatcgtgcaattagaattttcacccaaacagaagggaaactgattttagatgtgattgggcttcttgaggacatttctgtggtctcgttttattgtttttttttttagctttgttactatcttaaattctttggttatcagcctagcactaaatgacctttaattaaaaaaaaaaaaaaacaagagcctgtgaattcttaatattgtaaagtttgttcccaaagtgctgggttacagttgtgagccactgtgcccagctgcttgcttttttctttttttttggagagacatgtaacccttgatggagagaactctgtaatggaaaatactgctgactgttcagcaaccaggaccagctgcctgctaagaactttgctacatatttgctccttgttaacttgctgggccctgtcataatagaagtatctcagtttataatttacaactgatcatagttcagattggaaactcatcttttgaaattttagattttgtcctcttttacattacagtcaccaaagagccattcagtgaccgtaacataaaagatggtgggctatagtttttcttttaaggaaatggctctcttaaatttagggtgattcgtatatttctttgatattgtgataaaaactatggatatttgtctcagacgcccaaatgtccaaaatttttgagtccatttttaagggttcatggataatcaaaactatttttggccttaagataattgttttctaagaagtatagttcttaatacagttactgttaggggacacatatctgcatccttgttagactacttctaaatgaatcctagagtaaaggttatt

SEQ ID NO: 405884 - DNA, 758 bp, Homo sapiens
agagaaagtcgacatgttctcgcaggctgccgggcgtcccggggttgcctcttgcctgtgaccctgacgggagacagagcgcgggcggccgcggcgtccctgtcagcgcccgcggcgaggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgagcggcaggcaaaattggtatgtcagtgtggactccgtgttggcagcagtgctgttaccactctgggtgatccagccaaagtattacttttacgaactttcaggcaacaccgttattgaacgacccagacagatctgtccttatgtaattgtagcttttcgatacagggaatctaaaactatggcaccaccagctcataaaagcatacttgaacgcagtgaaaatgttctcatgtctccatggaaagggaaattaattgttcaagaccgtatgctatgtgatatagctctttggtccacttacggtgcaatgattccaacacagctaccgcaggaactagattttaaatatgtaatgaaagtgtcttccttgaaaaaaagactaccagaggctgccttcagaaaacagaattacttggaggagaatctgttttcaagatttgtgcttcaatttgtatgaggtagaactgtcaaacagacaagg

SEQ ID NO: 405885 - DNA, 2682 bp, Homo sapiens
  misc_feature (1497)..(1497): n is a, c, g, or t
  misc_feature (1756)..(1756): n is a, c, g, or t
  misc_feature (2071)..(2071): n is a, c, g, or t
  misc_feature (2086)..(2086): n is a, c, g, or t
agacgtcattatcagtccacatctctgaaggatcacgtttctgaaggatggtcaacagcattagacatgctgacaaggaaccgtggcagcccagtgtcacctacagtcctggacatgtgggggcaagaaggtacacatgagtgtgtggttatgagtcaggagcaccacgggatgaccttcagatcaggcatgacaaggtcctgcttagaggacggtctgggcttgtgtacctttatccggcagggacctacccagctggattgacctcactcatgccctctggtttccctgcaggagccagagcctgcagggtgggtgtcgggacatgctgatcttccctcaagacaggtgagtggcctgggtttagcttggggacatcctctcccacataggacagcagagtgttctggtgggcctggcgggtgggggtgacagggatggactggccctggacactgtgtgctcctggtccttctcaccctgggtaggcacagcccctgggctggacagggtggatgtgagggcctcctgccaccagcttgggtttgttactggcctgaatatgggcagcagccactggtttgatgtctggctttagggacaagcctgtttggggctggctgacgaggttgctggtcagtgttggtttggacattcactgggtctgctcttcacctgcctgagctaggatgccagccgcagtggcatccagtattggcacagcctgctgggccaggccattcgcttgccccccagagactggagccacagggacagaggatagtcctggaggccaggcacacaaaactttgtttgaaaaggtctgatagtaagtaattcaattttgcaggccttatggtctctgtcacagctgcagttctctgccattgtaggatgaaaatggctgcagacagcccataactgaatagtctgaatgtactctgatcacagccgtaggccatgtgtactggcccgtggcctcaggtgttatctgtgtttggggttcctctgcttatcatggctgctagctccagtgggactgaggcatagcgcctgggaagcatggcagggttggaggctgagtggtccatgtcccccaggaccctctgaaggatggtaaggcataccctgctcacatccacgctgccagagttttgccacgatgggtgctgttcagcagagtgggtgatggcttaagagaatggctcctggccattcttgttcctccagtccccaccctggccatctgcctgtccccccaaaaagcagtctctgtgggaggcatggctgacagccctgtggtttctcagtgacaattagtgcccattgtggaggcatggcccagccagtgctgtgcctaagtggtagggagaaggccatggcctccggatgcctgagtgacctaggctgagggatctagggcagatgggagggacaggatgactgactccttgcctgttcccaagtccttgggcatggaaagctgccggccgggcnagcctagtgggagctgggtctgctgccgcctggctgtgtgggaggaccagcgtctggccgagaatgtcactgctcaggccatttggccatgcagggtcttctgggttgggacaaagaagctcaggcagggtacttggcttgcttgtggcacaggtgacagggcatctcagggtggcaggaggggctgtcccactgcccttaactcctcgtaggtcaccacacttcagggaggccaggtcagccagacaccaaacgacanccctggtaacagggtccgcaggagggtggttggctgggcaggtccgaggctgcccaggcacacttgctcactctccctcctgttgcttgctcctttcttgtcccttcttttccctcccccctccagttcttggtcttctctatgtttctctgtggccctctctgtgcctctttctctgcctttccccatctcctatcctgcccatctggaatgtggtgattgcttattcctgtctgctgtggtgattggtttttcatgtctgccctgggcactggtgcgatgggtgatggcatttgtgccatctctgctctggcntgggcaacctgggcnctggcttgcggctgcctgctctgctgggccctggggtgtggtcctgtccacagcgggaggcagctggggagggagcctcagggctcagctgggacaggggctgatgtaaacacccatgtgtcaccacactcagcacccactcacccagcctcatgctgggtcctgggcatcacaggcacatcaggcccagccctgcccctgaggagctcccagcctggttgaggagatccacaacacacagaggaaccagtggccaactgtggggttacaagatggtgatgagtagcatggctcccttaggagggggagctgggagggtgtgatggggtggtgcgtgctgagaccaggcctgagtgagaagggctggcggggacacagatgccctgccgtttcccatagctggccagcagtggtgtcctctcagagaccagcaccagcctggcctcctccatcagccgccgtgtgcctgcagggggttgcggcttcgtctcctgcggccgcctggcccctatgacaggccttctcttgggttttgatgtgtttctcagccattgtatgagtctttgtatattaaagatattaattcttcactcctc

SEQ ID NO: 405886 - DNA, 1256 bp, Homo sapiens
  misc_feature (560)..(560): n is a, c, g, or t
tgtgtcggccctggcgtctgctgttcggctagtgctcgcggtgggccgggctgggcggcgtgggcggtgtttctgtgtgcgtgtgtgcctcagccccctgtcgtgtgttgcgtgtgcgccgctgcgcgtctggctgcgtgctgtctacgcgccgcggtcgtgctctcttccgttggtcgtttgtgctgctcctacctcttcacgcctcactcctgcctgttgcttgctttctgacgtcctcccgctgctccctccgcccgccttagtttgtgtcgccggcgtccgcctggacgtaactagataacgacgtgcccagtttttcacatcttcaagccgcccgcggagaaaaagtgtgttctacggatcaatcacgtccgtgggggcgcaaaatcttcttccatggggccggctaagtatatactgcggcggtggggtgaccacgcctaaaagacacgtcccgaaatttgttaattatttgcgcccccctgaagggcgcggttatcattatctcctctgtagtgtaggtggttggtcgctcgcagatttggttcggccccgcnacagtagtagtagggggtcgtctcttcccgcacaaaggatcctccaccagaagtgcagacatttgtttctcccctgcgccacgtgtgggttagtaaacaccgcgccgccgcctttttataaccgccccttatagggggcccccttttacaaaaaaagggggggggcggagtgggggccccccggggggagtatttttggggcggcgcccccccctttttttttttttttttttttttttttttttttttttttttttttttttttttttttttagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaaacaagttgctttcggtcaccttttgataggaaaatcttgatcaccctggctatataatagtgttcacccaaaagaattgtcctctttttgaataaggcccc

SEQ ID NO: 405887 - DNA, 283 bp, Homo sapiens
agcgtcccaggacatcatcccccagctgaagaagaattatgatgtcctgggacgctcaaccacaagggtgaccttgtccttcatgccagcgaaatccaccatccgctgggtgatggcggcacagtcggggttgatctcgatggtgatgagcctcgcccctggtgacagcaggcgggccatgcgcacagctgagtagccacagtaggcccccagctccagcagcacggagggctggtgctcctgaatcacggcgtccacgatcttgcctgtgcagggttgggga

SEQ ID NO: 405888 - DNA, 7669 bp, Homo sapiens
  misc_feature (6736)..(6736): n is a, c, g, or t
gcggccgaggcgccggagccgagcctggtccagccaccgcctcccccgctgctggccagcgccccccgagtcccggcccgatgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacagtgtggggggtgccccacaaggctcagccctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccactcaggtctggcacaagtggctggcttctcccttgtgtcgggcctctgcgcgtctggggcagggccctgggtggaggtggtcccaggtgcccatctgctgtgtcctgcagaggctctgtttctggtccctgggtggccccaaacttgtccacttgggctcactggtctgtctatccataggagtgggctggctgggggctagccaggccttgagcccaggagtagaatcttggctaggggctggtctcggtgcaggtgaactcagctagcacagggttgattcctgtcctgggcctgggaactgggcccttggagcctctgaggtggctagcagtctgaccccttggaggagatggggacagctctaggtgtaggtggacagaaaccagcactgcatcctcactcatgggccagggaggcaactacagggatgcgggagctggtctgagccattgcctcttctgtaagcaaggcccagtggggagtagggaaggagatgcttccactctgtgccacatggggcccagaggggctggtgctgctgcggggtccacctgtccccagcgcctgcttggtcagaaaggtgtgaatgctggctgactcctcttcgtttcccaggctggcagtcgtccccatggggctaacaggtgcccctggcctagctgcaggagggctgacctctgcaccactgtggctgggaggccagtgggccaggcgtgccacccagaacccagccagctaggggccccgcccttagcgttagcgtccgtcaaggggagctttgaatgtttggtgcccaagtcaagggcagcaggggaatggcagttgagaaggatgtactaagtcgagttatatctaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctgcaaacagaccggggggtgggggaggtgagggtcagaggtgcccagagaacctgccccaaaccaggatgggtgctcctcactaggccacggcaccacgcctgtgcctagcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctggtatggtccctggagacaatattggcctgaccagggtgaccctgcagggctgaggtggggcagacctcccatcaacaagcctgccccttggggtcagttctggacatccccaagctcctgcatttgcagaccccccatcttcaccagtgcctgggccctgggaggacacagagttcctctgcctgggttctgtgcagaaggaaggagttgttactggacacgcagccatagggcatggcccgtggggtccactatcgggagaaacctcataggatgcttgcctatctatgctatcagaaaagggtttgcttacatcacataaacaagaaaccttgagaggaagtgtttgcctatggggaggaaggacctaccagggcaagggacaccccagtcaccttgtcttggaaatttgacttagtcaccaaacaaaagttaacaagcaatctcaaacatctaaagtataataaaatcaatttgcaggcaggtgccttgaaacactggtatccgaccccacatgcctctgggatgggcctggagagtcccacagggcttgcagctgtcctggtggtgggtggcggtcgtttccagcctgtatgctgcagagaaagcagggggctttcatgtgacagtatggacaccacacggctgcaaggtcagtgaggtcaggggacagccccaaggtccggagttgagcaggaagtaccaccatgaatcatgatgtgttttcatttagaaaaaaaaaaaaatgtcctagcaatgtcagctgaaaagacgtagaacaaagcgccacccgggaggaggacaatggcctaggccttgagcagggcggctgccttccagtctgggccagggaatgcatgagtgaggggcctgggctcctggacttctcgggttgcgccaggggactcaggagcccaatctggtcatcagggatacagaagacgtcagcggactgaaagacaccagaccactgcacctgcacgagttaaacaggaaagaaggagggaagggcagaaaggagcatgggtcacctttggaggctgccaggggcccactcctttacgaaactggtcaagaggggaaagaaggcagcacctgtcctgcctgtcgcccgacactgcaagcctcctaccagctactcagaccacctggagaactggctaaacatgcatcagcgtctgagcaggactgaaaatctaatgccatggagaagcgacagtgtcagaggagcaggtgacactatgctgaggtggttttcatctggcccaccctccttagactctcctcccttcaagagttggagcctcacagaggttgcagggagccaagatcgcgccactgcactccagcctgggcnacagagcgagagactgtctcgagaaacaacaacaaaaagttggagcctcagaccaagcacacacctgtactcccagcactttgggaggttgaggcaagaggatcgcttgaggccaggagtttgagaccagtctgggcaacatagggagaccccatttctacaaaaaatttttaaattagccaggtgtagtggtgcatgcctttagtcctagctactcaggaggctgaggtgggaggatcactggagctcaggagtttgaggctacagtgagctatgatgtcatcactgcactccagcctgggcacagagcaagactctgtctttttctttttttttttttttttaagggggaactcattcctcttcctttgggcatgggctggacttggtgactacagcagcccggtggagaggcctcctcaaagcagcccttgattttgaattgcaacctgctcctgagcccctcaccccccgtgcctccgatgctcacagaacccactgaggggatggctagaccctcacaagagccaggttgtcccctaaccctccacaagggggcacagggccccagccctgagtgtgcagatgtgcgtttaacaaggacacccattcccaattcatgacttcccacttcatgactttgcttcttttgagataattaccagctttgcgcaagcagcactgagaaaactattagtttcctagttactaaactgcaatgtttgctacttttctatgaaggcaggcccctgtaattagcacccacatcacagctgctgaaactcggccgcagtaacgcaggcccagctgtgggtgtctttcctgcccaagtgaagcccatctggctgagtgccagctctctgccatcaatacccaattgccagcatcatgctcctttgtcaggggtgagcccccctccagctaccctgtctt

SEQ ID NO: 405889 - DNA, 8154 bp, Homo sapiens
  misc_feature (7221)..(7221): n is a, c, g, or t
gagggactgttttgtctggacatcggtaacattgcagtcgagacttagacttggagtcagacctatattggattagaaacctagttctgtccttcctatgcaggtggccctggatgagtcacggtagtcattggatattcggtttgcacatctgtaagatggggtaaaaagaattgcatttgggatcatgagtattataagtttatagctgaggacttctgatgatggaggtgggcattgtcctaaatgccacatgtccatgactccatcgacttctcagggtgcactgacacgggttgggattaccaggggcccctggtatccccaccccactgagcttactctgctttgcctgcagctggcgggcgctctggtcatggaggactgcaatgtgcactcggccgccagcatcctggcctcggtgaaggagcaggaggcccgcttcgagaggctgacacgggcactggagcaggagcggcgccatgttgccctacagctggagcgtgcccagcagcctggcatggtcagtggtggcatgggcagtgggcagcccctgccaatggcctggcaacagctggtcctccaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacagtgtggggggtgccccacaaggctcagccctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccactcaggtctggcacaagtggctggcttctcccttgtgtcgggcctctgcgcgtctggggcagggccctgggtggaggtggtcccaggtgcccatctgctgtgtcctgcagaggctctgtttctggtccctgggtggccccaaacttgtccacttgggctcactggtctgtctatccataggagtgggctggctgggggctagccaggccttgagcccaggagtagaatcttggctaggggctggtctcggtgcaggtgaactcagctagcacagggttgattcctgtcctgggcctgggaactgggcccttggagcctctgaggtggctagcagtctgaccccttggaggagatggggacagctctaggtgtaggtggacagaaaccagcactgcatcctcactcatgggccagggaggcaactacagggatgcgggagctggtctgagccattgcctcttctgtaagcaaggcccagtggggagtagggaaggagatgcttccactctgtgccacatggggcccagaggggctggtgctgctgcggggtccacctgtccccagcgcctgcttggtcagaaaggtgtgaatgctggctgactcctcttcgtttcccaggctggcagtcgtccccatggggctaacaggtgcccctggcctagctgcaggagggctgacctctgcaccactgtggctgggaggccagtgggccaggcgtgccacccagaacccagccagctaggggccccgcccttagcgttagcgtccgtcaaggggagctttgaatgtttggtgcccaagtcaagggcagcaggggaatggcagttgagaaggatgtactaagtcgagttatatctaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctgcaaacagaccggggggtgggggaggtgagggtcagaggtgcccagagaacctgccccaaaccaggatgggtgctcctcactaggccacggcaccacgcctgtgcctagcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctggtatggtccctggagacaatattggcctgaccagggtgaccctgcagggctgaggtggggcagacctcccatcaacaagcctgccccttggggtcagttctggacatccccaagctcctgcatttgcagaccccccatcttcaccagtgcctgggccctgggaggacacagagttcctctgcctgggttctgtgcagaaggaaggagttgttactggacacgcagccatagggcatggcccgtggggtccactatcgggagaaacctcataggatgcttgcctatctatgctatcagaaaagggtttgcttacatcacataaacaagaaaccttgagaggaagtgtttgcctatggggaggaaggacctaccagggcaagggacaccccagtcaccttgtcttggaaatttgacttagtcaccaaacaaaagttaacaagcaatctcaaacatctaaagtataataaaatcaatttgcaggcaggtgccttgaaacactggtatccgaccccacatgcctctgggatgggcctggagagtcccacagggcttgcagctgtcctggtggtgggtggcggtcgtttccagcctgtatgctgcagagaaagcagggggctttcatgtgacagtatggacaccacacggctgcaaggtcagtgaggtcaggggacagccccaaggtccggagttgagcaggaagtaccaccatgaatcatgatgtgttttcatttagaaaaaaaaaaaaatgtcctagcaatgtcagctgaaaagacgtagaacaaagcgccacccgggaggaggacaatggcctaggccttgagcagggcggctgccttccagtctgggccagggaatgcatgagtgaggggcctgggctcctggacttctcgggttgcgccaggggactcaggagcccaatctggtcatcagggatacagaagacgtcagcggactgaaagacaccagaccactgcacctgcacgagttaaacaggaaagaaggagggaagggcagaaaggagcatgggtcacctttggaggctgccaggggcccactcctttacgaaactggtcaagaggggaaagaaggcagcacctgtcctgcctgtcgcccgacactgcaagcctcctaccagctactcagaccacctggagaactggctaaacatgcatcagcgtctgagcaggactgaaaatctaatgccatggagaagcgacagtgtcagaggagcaggtgacactatgctgaggtggttttcatctggcccaccctccttagactctcctcccttcaagagttggagcctcacagaggttgcagggagccaagatcgcgccactgcactccagcctgggcnacagagcgagagactgtctcgagaaacaacaacaaaaagttggagcctcagaccaagcacacacctgtactcccagcactttgggaggttgaggcaagaggatcgcttgaggccaggagtttgagaccagtctgggcaacatagggagaccccatttctacaaaaaatttttaaattagccaggtgtagtggtgcatgcctttagtcctagctactcaggaggctgaggtgggaggatcactggagctcaggagtttgaggctacagtgagctatgatgtcatcactgcactccagcctgggcacagagcaagactctgtctttttctttttttttttttttttaagggggaactcattcctcttcctttgggcatgggctggacttggtgactacagcagcccggtggagaggcctcctcaaagcagcccttgattttgaattgcaacctgctcctgagcccctcaccccccgtgcctccgatgctcacagaacccactgaggggatggctagaccctcacaagagccaggttgtcccctaaccctccacaagggggcacagggccccagccctgagtgtgcagatgtgcgtttaacaaggacacccattcccaattcatgacttcccacttcatgactttgcttcttttgagataattaccagctttgcgcaagcagcactgagaaaactattagtttcctagttactaaactgcaatgtttgctacttttctatgaaggcaggcccctgtaattagcacccacatcacagctgctgaaactcggccgcagtaacgcaggcccagctgtgggtgtctttcctgcccaagtgaagcccatctggctgagtgccagctctctgccatcaatacccaattgccagcatcatgctcctttgtcaggggtgagcccccctccagctaccctgtctt

SEQ ID NO: 405890 - DNA, 5771 bp, Homo sapiens
  misc_feature (4838)..(4838): n is a, c, g, or t
cttctcaccaccctcacacctgaggctgcgcgggctctgagaacctcagtgcggcactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacagtgtggggggtgccccacaaggctcagccctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccactcaggtctggcacaagtggctggcttctcccttgtgtcgggcctctgcgcgtctggggcagggccctgggtggaggtggtcccaggtgcccatctgctgtgtcctgcagaggctctgtttctggtccctgggtggccccaaacttgtccacttgggctcactggtctgtctatccataggagtgggctggctgggggctagccaggccttgagcccaggagtagaatcttggctaggggctggtctcggtgcaggtgaactcagctagcacagggttgattcctgtcctgggcctgggaactgggcccttggagcctctgaggtggctagcagtctgaccccttggaggagatggggacagctctaggtgtaggtggacagaaaccagcactgcatcctcactcatgggccagggaggcaactacagggatgcgggagctggtctgagccattgcctcttctgtaagcaaggcccagtggggagtagggaaggagatgcttccactctgtgccacatggggcccagaggggctggtgctgctgcggggtccacctgtccccagcgcctgcttggtcagaaaggtgtgaatgctggctgactcctcttcgtttcccaggctggcagtcgtccccatggggctaacaggtgcccctggcctagctgcaggagggctgacctctgcaccactgtggctgggaggccagtgggccaggcgtgccacccagaacccagccagctaggggccccgcccttagcgttagcgtccgtcaaggggagctttgaatgtttggtgcccaagtcaagggcagcaggggaatggcagttgagaaggatgtactaagtcgagttatatctaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctgcaaacagaccggggggtgggggaggtgagggtcagaggtgcccagagaacctgccccaaaccaggatgggtgctcctcactaggccacggcaccacgcctgtgcctagcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctggtatggtccctggagacaatattggcctgaccagggtgaccctgcagggctgaggtggggcagacctcccatcaacaagcctgccccttggggtcagttctggacatccccaagctcctgcatttgcagaccccccatcttcaccagtgcctgggccctgggaggacacagagttcctctgcctgggttctgtgcagaaggaaggagttgttactggacacgcagccatagggcatggcccgtggggtccactatcgggagaaacctcataggatgcttgcctatctatgctatcagaaaagggtttgcttacatcacataaacaagaaaccttgagaggaagtgtttgcctatggggaggaaggacctaccagggcaagggacaccccagtcaccttgtcttggaaatttgacttagtcaccaaacaaaagttaacaagcaatctcaaacatctaaagtataataaaatcaatttgcaggcaggtgccttgaaacactggtatccgaccccacatgcctctgggatgggcctggagagtcccacagggcttgcagctgtcctggtggtgggtggcggtcgtttccagcctgtatgctgcagagaaagcagggggctttcatgtgacagtatggacaccacacggctgcaaggtcagtgaggtcaggggacagccccaaggtccggagttgagcaggaagtaccaccatgaatcatgatgtgttttcatttagaaaaaaaaaaaaatgtcctagcaatgtcagctgaaaagacgtagaacaaagcgccacccgggaggaggacaatggcctaggccttgagcagggcggctgccttccagtctgggccagggaatgcatgagtgaggggcctgggctcctggacttctcgggttgcgccaggggactcaggagcccaatctggtcatcagggatacagaagacgtcagcggactgaaagacaccagaccactgcacctgcacgagttaaacaggaaagaaggagggaagggcagaaaggagcatgggtcacctttggaggctgccaggggcccactcctttacgaaactggtcaagaggggaaagaaggcagcacctgtcctgcctgtcgcccgacactgcaagcctcctaccagctactcagaccacctggagaactggctaaacatgcatcagcgtctgagcaggactgaaaatctaatgccatggagaagcgacagtgtcagaggagcaggtgacactatgctgaggtggttttcatctggcccaccctccttagactctcctcccttcaagagttggagcctcacagaggttgcagggagccaagatcgcgccactgcactccagcctgggcnacagagcgagagactgtctcgagaaacaacaacaaaaagttggagcctcagaccaagcacacacctgtactcccagcactttgggaggttgaggcaagaggatcgcttgaggccaggagtttgagaccagtctgggcaacatagggagaccccatttctacaaaaaatttttaaattagccaggtgtagtggtgcatgcctttagtcctagctactcaggaggctgaggtgggaggatcactggagctcaggagtttgaggctacagtgagctatgatgtcatcactgcactccagcctgggcacagagcaagactctgtctttttctttttttttttttttttaagggggaactcattcctcttcctttgggcatgggctggacttggtgactacagcagcccggtggagaggcctcctcaaagcagcccttgattttgaattgcaacctgctcctgagcccctcaccccccgtgcctccgatgctcacagaacccactgaggggatggctagaccctcacaagagccaggttgtcccctaaccctccacaagggggcacagggccccagccctgagtgtgcagatgtgcgtttaacaaggacacccattcccaattcatgacttcccacttcatgactttgcttcttttgagataattaccagctttgcgcaagcagcactgagaaaactattagtttcctagttactaaactgcaatgtttgctacttttctatgaaggcaggcccctgtaattagcacccacatcacagctgctgaaactcggccgcagtaacgcaggcccagctgtgggtgtctttcctgcccaagtgaagcccatctggctgagtgccagctctctgccatcaatacccaattgccagcatcatgctcctttgtcaggggtgagcccccctccagctaccctgtctt

SEQ ID NO: 405891 - DNA, 4114 bp, Homo sapiens
gcggccgaggcgccggagccgagcctggtccagccaccgcctcccccgctgctggccagcgccccccgagtcccggcccgatgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacagtgtggggggtgccccacaaggctcagccctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccactcaggtctggcacaagtggctggcttctcccttgtgtcgggcctctgcgcgtctggggcagggccctgggtggaggtggtcccaggtgcccatctgctgtgtcctgcagaggctctgtttctggtccctgggtggccccaaacttgtccacttgggctcactggtctgtctatccataggagtgggctggctgggggctagccaggccttgagcccaggagtagaatcttggctaggggctggtctcggtgcaggtgaactcagctagcacagggttgattcctgtcctgggcctgggaactgggcccttggaggactaaccagccatgcaaggactaaccagccatgcaagttcggacaaaccagccatgcaagttcggactaaccagccatgcaagttcgggcaaaccagccatgcaagttcggactaaccagcccatgcaaagttcggactaaccagccatgcaagttcgg

SEQ ID NO: 405892 - DNA, 3377 bp, Homo sapiens
gcggccgaggcgccggagccgagcctggtccagccaccgcctcccccgctgctggccagcgccccccgagtcccggcccgatgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaagga

SEQ ID NO: 405893 - DNA, 3061 bp, Homo sapiens
  misc_feature (1497)..(1497): n is a, c, g, or t
  misc_feature (1756)..(1756): n is a, c, g, or t
  misc_feature (2071)..(2071): n is a, c, g, or t
  misc_feature (2086)..(2086): n is a, c, g, or t
agacgtcattatcagtccacatctctgaaggatcacgtttctgaaggatggtcaacagcattagacatgctgacaaggaaccgtggcagcccagtgtcacctacagtcctggacatgtgggggcaagaaggtacacatgagtgtgtggttatgagtcaggagcaccacgggatgaccttcagatcaggcatgacaaggtcctgcttagaggacggtctgggcttgtgtacctttatccggcagggacctacccagctggattgacctcactcatgccctctggtttccctgcaggagccagagcctgcagggtgggtgtcgggacatgctgatcttccctcaagacaggtgagtggcctgggtttagcttggggacatcctctcccacataggacagcagagtgttctggtgggcctggcgggtgggggtgacagggatggactggccctggacactgtgtgctcctggtccttctcaccctgggtaggcacagcccctgggctggacagggtggatgtgagggcctcctgccaccagcttgggtttgttactggcctgaatatgggcagcagccactggtttgatgtctggctttagggacaagcctgtttggggctggctgacgaggttgctggtcagtgttggtttggacattcactgggtctgctcttcacctgcctgagctaggatgccagccgcagtggcatccagtattggcacagcctgctgggccaggccattcgcttgccccccagagactggagccacagggacagaggatagtcctggaggccaggcacacaaaactttgtttgaaaaggtctgatagtaagtaattcaattttgcaggccttatggtctctgtcacagctgcagttctctgccattgtaggatgaaaatggctgcagacagcccataactgaatagtctgaatgtactctgatcacagccgtaggccatgtgtactggcccgtggcctcaggtgttatctgtgtttggggttcctctgcttatcatggctgctagctccagtgggactgaggcatagcgcctgggaagcatggcagggttggaggctgagtggtccatgtcccccaggaccctctgaaggatggtaaggcataccctgctcacatccacgctgccagagttttgccacgatgggtgctgttcagcagagtgggtgatggcttaagagaatggctcctggccattcttgttcctccagtccccaccctggccatctgcctgtccccccaaaaagcagtctctgtgggaggcatggctgacagccctgtggtttctcagtgacaattagtgcccattgtggaggcatggcccagccagtgctgtgcctaagtggtagggagaaggccatggcctccggatgcctgagtgacctaggctgagggatctagggcagatgggagggacaggatgactgactccttgcctgttcccaagtccttgggcatggaaagctgccggccgggcnagcctagtgggagctgggtctgctgccgcctggctgtgtgggaggaccagcgtctggccgagaatgtcactgctcaggccatttggccatgcagggtcttctgggttgggacaaagaagctcaggcagggtacttggcttgcttgtggcacaggtgacagggcatctcagggtggcaggaggggctgtcccactgcccttaactcctcgtaggtcaccacacttcagggaggccaggtcagccagacaccaaacgacanccctggtaacagggtccgcaggagggtggttggctgggcaggtccgaggctgcccaggcacacttgctcactctccctcctgttgcttgctcctttcttgtcccttcttttccctcccccctccagttcttggtcttctctatgtttctctgtggccctctctgtgcctctttctctgcctttccccatctcctatcctgcccatctggaatgtggtgattgcttattcctgtctgctgtggtgattggtttttcatgtctgccctgggcactggtgcgatgggtgatggcatttgtgccatctctgctctggcntgggcaacctgggcnctggcttgcggctgcctgctctgctgggccctggggtgtggtcctgtccacagcgggaggcagctggggagggagcctcagggctcagctgggacaggggctgatgtaaacacccatgtgtcaccacactcagcacccactcacccagcctcatgctgggtcctgggcatcacaggcacatcaggcccagccctgcccctgaggagctcccagcctggttgaggagatccacaacacacagaggaaccagtggccaactgtggggttacaagatggtgatgagtagcatggctcccttaggagggggagctgggagggtgtgatggggtggtgcgtgctgagaccaggcctgagtgagaagggctggcggggacacagatgccctgccgtttcccatagctggccagcagtggtgtcctctcagagaccagcaccagcctggcctcctccatcagccgccgtgtgcctgcagggggttgcggcttcgtctcctgcggccgcctggcccctatgacaggccttctcttgggttttgatgtgtttctcagccattgtatgagtctttgtatattaaagatattaattcttcactcctctttctgcctactgcacatttttctcacccttttagtttttgtttatgatcattttgatgtcaaaaatgtttcatattttgtggtgaagtgtgttggatttttccccatttttagatattccgtctctctgtgtagtcaactctccctagcatgcagccagataaagatgcacctgtcttttcttctagaaggtatttttactttagttttgtacacagcatttaatctgtctgtcttagtccattttgggctgctgtatcagaatacctgagactggctaattcctgaaaaacaaagacttatttctaacaattttggagatggggaagtccaggattgaggggccacatctggcgagggccttctttgtcgctacatc

SEQ ID NO: 405894 - DNA, 170 bp, Homo sapiens
ggactccaagccacgggacgccgagtggacaactgtcttcaagaacacgtcgggctgcctgaggtgtggaccagacctggtgctaaagcccacatgcacaccaggccccgtcctcgtggtcccagatagtgtggaagatggcggcgagcttaggagcgccagagcttagg

SEQ ID NO: 405895 - DNA, 4001 bp, Homo sapiens
cggtctcgggttgcgcgctgggcctggagggagggggcggcccccgcaccggtccgagttgcggccgcgtggactgcgacccgcgccgcgccgcaccgcgccgcgccctgggaacgccgctccccgcgcgccaacggacccggggaagcccttctggggtccgaggccgcgctgcggggccgcccacgctgcgctccaggagccagagcctgcagggtgggtgtcgggacatgctgatcttccctcaagacagctggcgggcgctctggtcatggaggactgcaatgtgcactcggccgccagcatcctggcctcggtgaaggagcaggaggcccgcttcgagaggctgacacgggcactggagcaggagcggcgccatgttgccctacagctggagcgtgcccagcagcctggcatggtcagtggtggcatgggcagtgggcagcccctgccaatggcctggcaacagctggtcctccaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacagtgtggggggtgccccacaaggctcagccctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaagga

SEQ ID NO: 405896 - DNA, 7549 bp, Homo sapiens
  misc_feature (6616)..(6616): n is a, c, g, or t
gcggccgaggcgccggagccgagcctggtccagccaccgcctcccccgctgctggccagcgccccccgagtcccggcccgatgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaaggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacagtgtggggggtgccccacaaggctcagccctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccactcaggtctggcacaagtggctggcttctcccttgtgtcgggcctctgcgcgtctggggcagggccctgggtggaggtggtcccaggtgcccatctgctgtgtcctgcagaggctctgtttctggtccctgggtggccccaaacttgtccacttgggctcactggtctgtctatccataggagtgggctggctgggggctagccaggccttgagcccaggagtagaatcttggctaggggctggtctcggtgcaggtgaactcagctagcacagggttgattcctgtcctgggcctgggaactgggcccttggagcctctgaggtggctagcagtctgaccccttggaggagatggggacagctctaggtgtaggtggacagaaaccagcactgcatcctcactcatgggccagggaggcaactacagggatgcgggagctggtctgagccattgcctcttctgtaagcaaggcccagtggggagtagggaaggagatgcttccactctgtgccacatggggcccagaggggctggtgctgctgcggggtccacctgtccccagcgcctgcttggtcagaaaggtgtgaatgctggctgactcctcttcgtttcccaggctggcagtcgtccccatggggctaacaggtgcccctggcctagctgcaggagggctgacctctgcaccactgtggctgggaggccagtgggccaggcgtgccacccagaacccagccagctaggggccccgcccttagcgttagcgtccgtcaaggggagctttgaatgtttggtgcccaagtcaagggcagcaggggaatggcagttgagaaggatgtactaagtcgagttatatctaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctgcaaacagaccggggggtgggggaggtgagggtcagaggtgcccagagaacctgccccaaaccaggatgggtgctcctcactaggccacggcaccacgcctgtgcctagcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctggtatggtccctggagacaatattggcctgaccagggtgaccctgcagggctgaggtggggcagacctcccatcaacaagcctgccccttggggtcagttctggacatccccaagctcctgcatttgcagaccccccatcttcaccagtgcctgggccctgggaggacacagagttcctctgcctgggttctgtgcagaaggaaggagttgttactggacacgcagccatagggcatggcccgtggggtccactatcgggagaaacctcataggatgcttgcctatctatgctatcagaaaagggtttgcttacatcacataaacaagaaaccttgagaggaagtgtttgcctatggggaggaaggacctaccagggcaagggacaccccagtcaccttgtcttggaaatttgacttagtcaccaaacaaaagttaacaagcaatctcaaacatctaaagtataataaaatcaatttgcaggcaggtgccttgaaacactggtatccgaccccacatgcctctgggatgggcctggagagtcccacagggcttgcagctgtcctggtggtgggtggcggtcgtttccagcctgtatgctgcagagaaagcagggggctttcatgtgacagtatggacaccacacggctgcaaggtcagtgaggtcaggggacagccccaaggtccggagttgagcaggaagtaccaccatgaatcatgatgtgttttcatttagaaaaaaaaaaaaatgtcctagcaatgtcagctgaaaagacgtagaacaaagcgccacccgggaggaggacaatggcctaggccttgagcagggcggctgccttccagtctgggccagggaatgcatgagtgaggggcctgggctcctggacttctcgggttgcgccaggggactcaggagcccaatctggtcatcagggatacagaagacgtcagcggactgaaagacaccagaccactgcacctgcacgagttaaacaggaaagaaggagggaagggcagaaaggagcatgggtcacctttggaggctgccaggggcccactcctttacgaaactggtcaagaggggaaagaaggcagcacctgtcctgcctgtcgcccgacactgcaagcctcctaccagctactcagaccacctggagaactggctaaacatgcatcagcgtctgagcaggactgaaaatctaatgccatggagaagcgacagtgtcagaggagcaggtgacactatgctgaggtggttttcatctggcccaccctccttagactctcctcccttcaagagttggagcctcacagaggttgcagggagccaagatcgcgccactgcactccagcctgggcnacagagcgagagactgtctcgagaaacaacaacaaaaagttggagcctcagaccaagcacacacctgtactcccagcactttgggaggttgaggcaagaggatcgcttgaggccaggagtttgagaccagtctgggcaacatagggagaccccatttctacaaaaaatttttaaattagccaggtgtagtggtgcatgcctttagtcctagctactcaggaggctgaggtgggaggatcactggagctcaggagtttgaggctacagtgagctatgatgtcatcactgcactccagcctgggcacagagcaagactctgtctttttctttttttttttttttttaagggggaactcattcctcttcctttgggcatgggctggacttggtgactacagcagcccggtggagaggcctcctcaaagcagcccttgattttgaattgcaacctgctcctgagcccctcaccccccgtgcctccgatgctcacagaacccactgaggggatggctagaccctcacaagagccaggttgtcccctaaccctccacaagggggcacagggccccagccctgagtgtgcagatgtgcgtttaacaaggacacccattcccaattcatgacttcccacttcatgactttgcttcttttgagataattaccagctttgcgcaagcagcactgagaaaactattagtttcctagttactaaactgcaatgtttgctacttttctatgaaggcaggcccctgtaattagcacccacatcacagctgctgaaactcggccgcagtaacgcaggcccagctgtgggtgtctttcctgcccaagtgaagcccatctggctgagtgccagctctctgccatcaatacccaattgccagcatcatgctcctttgtcaggggtgagcccccctccagctaccctgtctt

SEQ ID NO: 405897 - DNA, 7131 bp, Homo sapiens
  misc_feature (6198)..(6198): n is a, c, g, or t
gcggccgaggcgccggagccgagcctggtccagccaccgcctcccccgctgctggccagcgccccccgagtcccggcccgatgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccactcaggtctggcacaagtggctggcttctcccttgtgtcgggcctctgcgcgtctggggcagggccctgggtggaggtggtcccaggtgcccatctgctgtgtcctgcagaggctctgtttctggtccctgggtggccccaaacttgtccacttgggctcactggtctgtctatccataggagtgggctggctgggggctagccaggccttgagcccaggagtagaatcttggctaggggctggtctcggtgcaggtgaactcagctagcacagggttgattcctgtcctgggcctgggaactgggcccttggagcctctgaggtggctagcagtctgaccccttggaggagatggggacagctctaggtgtaggtggacagaaaccagcactgcatcctcactcatgggccagggaggcaactacagggatgcgggagctggtctgagccattgcctcttctgtaagcaaggcccagtggggagtagggaaggagatgcttccactctgtgccacatggggcccagaggggctggtgctgctgcggggtccacctgtccccagcgcctgcttggtcagaaaggtgtgaatgctggctgactcctcttcgtttcccaggctggcagtcgtccccatggggctaacaggtgcccctggcctagctgcaggagggctgacctctgcaccactgtggctgggaggccagtgggccaggcgtgccacccagaacccagccagctaggggccccgcccttagcgttagcgtccgtcaaggggagctttgaatgtttggtgcccaagtcaagggcagcaggggaatggcagttgagaaggatgtactaagtcgagttatatctaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctgcaaacagaccggggggtgggggaggtgagggtcagaggtgcccagagaacctgccccaaaccaggatgggtgctcctcactaggccacggcaccacgcctgtgcctagcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctggtatggtccctggagacaatattggcctgaccagggtgaccctgcagggctgaggtggggcagacctcccatcaacaagcctgccccttggggtcagttctggacatccccaagctcctgcatttgcagaccccccatcttcaccagtgcctgggccctgggaggacacagagttcctctgcctgggttctgtgcagaaggaaggagttgttactggacacgcagccatagggcatggcccgtggggtccactatcgggagaaacctcataggatgcttgcctatctatgctatcagaaaagggtttgcttacatcacataaacaagaaaccttgagaggaagtgtttgcctatggggaggaaggacctaccagggcaagggacaccccagtcaccttgtcttggaaatttgacttagtcaccaaacaaaagttaacaagcaatctcaaacatctaaagtataataaaatcaatttgcaggcaggtgccttgaaacactggtatccgaccccacatgcctctgggatgggcctggagagtcccacagggcttgcagctgtcctggtggtgggtggcggtcgtttccagcctgtatgctgcagagaaagcagggggctttcatgtgacagtatggacaccacacggctgcaaggtcagtgaggtcaggggacagccccaaggtccggagttgagcaggaagtaccaccatgaatcatgatgtgttttcatttagaaaaaaaaaaaaatgtcctagcaatgtcagctgaaaagacgtagaacaaagcgccacccgggaggaggacaatggcctaggccttgagcagggcggctgccttccagtctgggccagggaatgcatgagtgaggggcctgggctcctggacttctcgggttgcgccaggggactcaggagcccaatctggtcatcagggatacagaagacgtcagcggactgaaagacaccagaccactgcacctgcacgagttaaacaggaaagaaggagggaagggcagaaaggagcatgggtcacctttggaggctgccaggggcccactcctttacgaaactggtcaagaggggaaagaaggcagcacctgtcctgcctgtcgcccgacactgcaagcctcctaccagctactcagaccacctggagaactggctaaacatgcatcagcgtctgagcaggactgaaaatctaatgccatggagaagcgacagtgtcagaggagcaggtgacactatgctgaggtggttttcatctggcccaccctccttagactctcctcccttcaagagttggagcctcacagaggttgcagggagccaagatcgcgccactgcactccagcctgggcnacagagcgagagactgtctcgagaaacaacaacaaaaagttggagcctcagaccaagcacacacctgtactcccagcactttgggaggttgaggcaagaggatcgcttgaggccaggagtttgagaccagtctgggcaacatagggagaccccatttctacaaaaaatttttaaattagccaggtgtagtggtgcatgcctttagtcctagctactcaggaggctgaggtgggaggatcactggagctcaggagtttgaggctacagtgagctatgatgtcatcactgcactccagcctgggcacagagcaagactctgtctttttctttttttttttttttttaagggggaactcattcctcttcctttgggcatgggctggacttggtgactacagcagcccggtggagaggcctcctcaaagcagcccttgattttgaattgcaacctgctcctgagcccctcaccccccgtgcctccgatgctcacagaacccactgaggggatggctagaccctcacaagagccaggttgtcccctaaccctccacaagggggcacagggccccagccctgagtgtgcagatgtgcgtttaacaaggacacccattcccaattcatgacttcccacttcatgactttgcttcttttgagataattaccagctttgcgcaagcagcactgagaaaactattagtttcctagttactaaactgcaatgtttgctacttttctatgaaggcaggcccctgtaattagcacccacatcacagctgctgaaactcggccgcagtaacgcaggcccagctgtgggtgtctttcctgcccaagtgaagcccatctggctgagtgccagctctctgccatcaatacccaattgccagcatcatgctcctttgtcaggggtgagcccccctccagctaccctgtctt

SEQ ID NO: 405898 - DNA, 5326 bp, Homo sapiens
gcggccgaggcgccggagccgagcctggtccagccaccgcctcccccgctgctggccagcgccccccgagtcccggcccgatgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccagagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacagtgtggggggtgccccacaaggctcagccctgggcaaggaagctttggaagcagcaaggtgggggtcaggctacaggtgccccacctccccagagccctgcagtcacgtgaggcccctgtgcagtagagagcctttctccagcccatgctggctgtggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaactttttgctttctgccactcaggtctggcacaagtggctggcttctcccttgtgtcgggcctctgcgcgtctggggcagggccctgggtggaggtggtcccaggtgcccatctgctgtgtcctgcagaggctctgtttctggtccctgggtggccccaaacttgtccacttgggctcactggtctgtctatccataggagtgggctggctgggggctagccaggccttgagcccaggagtagaatcttggctaggggctggtctcggtgcaggtgaactcagctagcacagggttgattcctgtcctgggcctgggaactgggcccttggagcctctgaggtggctagcagtctgaccccttggaggagatggggacagctctaggtgtaggtggacagaaaccagcactgcatcctcactcatgggccagggaggcaactacagggatgcgggagctggtctgagccattgcctcttctgtaagcaaggcccagtggggagtagggaaggagatgcttccactctgtgccacatggggcccagaggggctggtgctgctgcggggtccacctgtccccagcgcctgcttggtcagaaaggtgtgaatgctggctgactcctcttcgtttcccaggctggcagtcgtccccatggggctaacaggtgcccctggcctagctgcaggagggctgacctctgcaccactgtggctgggaggccagtgggccaggcgtgccacccagaacccagccagctaggggccccgcccttagcgttagcgtccgtcaaggggagctttgaatgtttggtgcccaagtcaagggcagcaggggaatggcagttgagaaggatgtactaagtcgagttatatctaaatatttagattcttaatttctattttatatttttaaaacatgatattagtatataagataatatagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctccaaaagaagcgtgtccggcaggtaccggtccttccagtggtcgaggaagaccatgtccagtgtgtccacatcatacttcttcttcagctgggggatgatgtcctgggacgctccaaccacaagggtgaccttgtccttcatgccagcgaaatccaccatccgctgggtgatggcggcacagtcggggttgatctcgatggtgatgagcctcgcccctggtgacagcaggcgggccatgcgcacagctgagtagccacagtaggcccccagctccagcagcacggagggctggtgctcctgaatcacggcgtccacgatcttgcctgtgcagggttgggga

SEQ ID NO: 405899 - DNA, 3940 bp, Homo sapiens
  misc_feature (560)..(560): n is a, c, g, or t
  misc_feature (3007)..(3007): n is a, c, g, or t
tgtgtcggccctggcgtctgctgttcggctagtgctcgcggtgggccgggctgggcggcgtgggcggtgtttctgtgtgcgtgtgtgcctcagccccctgtcgtgtgttgcgtgtgcgccgctgcgcgtctggctgcgtgctgtctacgcgccgcggtcgtgctctcttccgttggtcgtttgtgctgctcctacctcttcacgcctcactcctgcctgttgcttgctttctgacgtcctcccgctgctccctccgcccgccttagtttgtgtcgccggcgtccgcctggacgtaactagataacgacgtgcccagtttttcacatcttcaagccgcccgcggagaaaaagtgtgttctacggatcaatcacgtccgtgggggcgcaaaatcttcttccatggggccggctaagtatatactgcggcggtggggtgaccacgcctaaaagacacgtcccgaaatttgttaattatttgcgcccccctgaagggcgcggttatcattatctcctctgtagtgtaggtggttggtcgctcgcagatttggttcggccccgcnacagtagtagtagggggtcgtctcttcccgcacaaaggatcctccaccagaagtgcagacatttgtttctcccctgcgccacgtgtgggttagtaaacaccgcgccgccgcctttttataaccgccccttatagggggcccccttttacaaaaaaagggggggggcggagtgggggccccccggggggagtatttttggggcggcgcccccccctttttttttttttttttttttttttttttttttttttttttttttttttttttttttttagctagccagtgttagtaaagaagtcatgattgagtcttaaaaaagaacaatccagtgttgcagttcagagaggttagcatgtcagggcgcaggcctcggccgaggtgtgctttgcatttaggacacagcccggagccgcagaaggtcagcaggagcacgtctggcaccttcagtaccaggctgggtgagagagcccgagaggggggccggggggggcagtcagggccctgcttcgctgcctgggcccttgtagatggccttctccaggccgtccaccacctccctgtattccaggaacgattggtagtgtgtgcactcaaagcagctgctcccgcgcacgtgtgctaggaagtctggcgcacctgggcagatcacgttgtcagccagtagcactgtccccttccgcagcaggccacattcctgcaaacagaccggggggtgggggaggtgagggtcagaggtgcccagagaacctgccccaaaccaggatgggtgctcctcactaggccacggcaccacgcctgtgcctagcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctggtatggtccctggagacaatattggcctgaccagggtgaccctgcagggctgaggtggggcagacctcccatcaacaagcctgccccttggggtcagttctggacatccccaagctcctgcatttgcagaccccccatcttcaccagtgcctgggccctgggaggacacagagttcctctgcctgggttctgtgcagaaggaaggagttgttactggacacgcagccatagggcatggcccgtggggtccactatcgggagaaacctcataggatgcttgcctatctatgctatcagaaaagggtttgcttacatcacataaacaagaaaccttgagaggaagtgtttgcctatggggaggaaggacctaccagggcaagggacaccccagtcaccttgtcttggaaatttgacttagtcaccaaacaaaagttaacaagcaatctcaaacatctaaagtataataaaatcaatttgcaggcaggtgccttgaaacactggtatccgaccccacatgcctctgggatgggcctggagagtcccacagggcttgcagctgtcctggtggtgggtggcggtcgtttccagcctgtatgctgcagagaaagcagggggctttcatgtgacagtatggacaccacacggctgcaaggtcagtgaggtcaggggacagccccaaggtccggagttgagcaggaagtaccaccatgaatcatgatgtgttttcatttagaaaaaaaaaaaaatgtcctagcaatgtcagctgaaaagacgtagaacaaagcgccacccgggaggaggacaatggcctaggccttgagcagggcggctgccttccagtctgggccagggaatgcatgagtgaggggcctgggctcctggacttctcgggttgcgccaggggactcaggagcccaatctggtcatcagggatacagaagacgtcagcggactgaaagacaccagaccactgcacctgcacgagttaaacaggaaagaaggagggaagggcagaaaggagcatgggtcacctttggaggctgccaggggcccactcctttacgaaactggtcaagaggggaaagaaggcagcacctgtcctgcctgtcgcccgacactgcaagcctcctaccagctactcagaccacctggagaactggctaaacatgcatcagcgtctgagcaggactgaaaatctaatgccatggagaagcgacagtgtcagaggagcaggtgacactatgctgaggtggttttcatctggcccaccctccttagactctcctcccttcaagagttggagcctcacagaggttgcagggagccaagatcgcgccactgcactccagcctgggcnacagagcgagagactgtctcgagaaacaacaacaaaaagttggagcctcagaccaagcacacacctgtactcccagcactttgggaggttgaggcaagaggatcgcttgaggccaggagtttgagaccagtctgggcaacatagggagaccccatttctacaaaaaatttttaaattagccaggtgtagtggtgcatgcctttagtcctagctactcaggaggctgaggtgggaggatcactggagctcaggagtttgaggctacagtgagctatgatgtcatcactgcactccagcctgggcacagagcaagactctgtctttttctttttttttttttttttaagggggaactcattcctcttcctttgggcatgggctggacttggtgactacagcagcccggtggagaggcctcctcaaagcagcccttgattttgaattgcaacctgctcctgagcccctcaccccccgtgcctccgatgctcacagaacccactgaggggatggctagaccctcacaagagccaggttgtcccctaaccctccacaagggggcacagggccccagccctgagtgtgcagatgtgcgtttaacaaggacacccattcccaattcatgacttcccacttcatgactttgcttcttttgagataattaccagctttgcgcaagcagcactgagaaaactattagtttcctagttactaaactgcaatgtttgctacttttctatgaaggcaggcccctgtaattagcacccacatcacagctgctgaaactcggccgcagtaacgcaggcccagctgtgggtgtctttcctgcccaagtgaagcccatctggctgagtgccagctctctgccatcaatacccaattgccagcatcatgctcctttgtcaggggtgagcccccctccagctaccctgtctt

SEQ ID NO: 405900 - DNA, 494 bp, Homo sapiens
ctgctgccaggcaggtccaactgatttgagcctcagtttgttcctctgtgaaatgggaacgcttttccccttgggtgactatatgttgatagtaaatattacgtgactcatccacacccatccctggccccagctcacccacgccctgggagctctgaagcgggaagcgggaggggtatgatggatgagagcagattctgggtgaccgtgggtggcggttgccctgcacctaggctttgagctgctgtaccagcccgaggtggtacgtctctacctctccctcctcacggagagccggaacttcaacaccctggaggctgccgccggcgctctgcagaacctcagtgccggcaactggatggtgagggaccaggtcgggcagggtgggcaagtcctgagagagggaatcccaggcacctcactggtgcagctcctgcctcggctggcggggaaaggaggggccacaccaccaccccaggatccaagaggtgtat

SEQ ID NO: 405901 - DNA, 640 bp, Homo sapiens
tgacctgtcgtccttcctctcaccttgtaatctctgttctccttctccctgtatcatgaatgggaagcttcttgagtgtctctctggaagcagatcctggcaccatgcttcttgtatagtctgcagaaccatgagccaaataatcctcttttctttataaattacccagcctcaggtattcctttatagtaatgcgaacagactgagacaaccctctttctcgttctggaacaaccagcccttttattttaggacaaaactatttttttttccttaataaacaaaacccatcctactacctcacacgtagtgttgtacctgcctgccaccattgttctagtagtctcattcacatgttattgataacttttagccaaagtaacttttattacacagagaaaactagggagtggataattgtgagctgttgcatgccactgttttagcaaactagcagagctaacatccagagctaacacaactttaactgtgtgtacactttcattgtgtacaagtctcaagagtggcaaaaatgaacacatttaactgattaaaagagccaaagacatagcctctttgtagcatataaaaataagaaacaagtatatttgtcaggcctctgagcccaagcctgcatgta

SEQ ID NO: 405902 - DNA, 541 bp, Homo sapiens
aactaggctaggtagagctgcgtggtgaatcggccgaggctgggatgcatgaagggcgacgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405903 - DNA, 712 bp, Homo sapiens
aactaggctaggtagagctgcgtggtgaatcggccgaggctgggatgcatgaagggcgacgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtaaaaaaaaaaagaaaaaaaaaattggggggcattattatggggggtgcggggaaaagggggtatttagattgggccttgggtcattaggttggttccttggacccagttttttttggtccaaggggcgaagatcggcggggtcccccttataggggggccgaataaatgtcg

SEQ ID NO: 405904 - DNA, 1866 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405905 - DNA, 1628 bp, Homo sapiens
cggctcccacgggctttctgcgggcgcggcggggcgggcggtccctgcgctggagggagcagcggctcggggctgccttccccgccgctgtcacccccacccgcggcggacggctaatggggcgcagccggaccggggattatccggggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405906 - DNA, 1313 bp, Homo sapiens
ccttttttttaaaacccggcagtgagccgcagtcacttagagatcccgagagatcctgagacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405907 - DNA, 1208 bp, Homo sapiens
cctacaccgttccccaccaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405908 - DNA, 1768 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaagcatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405909 - DNA, 2037 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtaaaaaaaaaaagaaaaaaaaaattggggggcattattatggggggtgcggggaaaagggggtatttagattgggccttgggtcattaggttggttccttggacccagttttttttggtccaaggggcgaagatcggcggggtcccccttataggggggccgaataaatgtcg

SEQ ID NO: 405910 - DNA, 957 bp, Homo sapiens
ctctcaggatcttgacagacgcacgtaaccaactcatcacctatactctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405911 - DNA, 769 bp, Homo sapiens
caggatccccgtctgagatgacagtcgggtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405912 - DNA, 1577 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405913 - DNA, 1002 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccgggatcctctagaacgccgcagcact

SEQ ID NO: 405914 - DNA, 711 bp, Homo sapiens
tggcgcgggctgcggggtggggcagggccacagggccctggctggctctgaccccggcgcttcccctgctccgcaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactggtgaggggcctggcccagttcgggccctttttggggttggggggtgcactgccctccgtgtggagacctggctgaccagctccttccccagggtacctgtcgtgttgccgcttcctggatgacaaccaaatcatcaccagctctggggataccacctggtgaggctctgccagggctgggcagtctgggcaaacccacacttcctgcctcaggggccaccgtcccagtgctcaacatgcagcatgcaccgtagcctccctctcctggtgggcgctaagggggtcagggagggatgcgtcccctccccacctaaggctctgagaagagcctccctggacccttccacagggttgggctcacgtggtggggcggggagaacagggactctgttcttcgccctgtctcttatcttttctttcttcctgtcacctctccagtgccctgtgggacattgagacaggccagcagacag

SEQ ID NO: 405915 - DNA, 381 bp, Homo sapiens
gcggccgcctactactactactgctcgaattcaagcttctaacgatgtacctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405916 - DNA, 290 bp, Homo sapiens
  misc_feature (23)..(23): n is a, c, g, or t
gtgaccctagaggatactctgtnattcaagcaggtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgactgcttggattacaagggagggtacccgcgctcga

SEQ ID NO: 405917 - DNA, 1564 bp, Homo sapiens
ccccttccgggccgcgctgcaaccccgcctttctccccacttccccggcggcctcgggcctgacgtcagccctgcatcccccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405918 - DNA, 1328 bp, Homo sapiens
  misc_feature (25)..(26): n is a, c, g, or t
actccagaggatccacggccgcatnngacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405919 - DNA, 2091 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtaaaaaacacacaaaaaaaacaaaaacaaacaacaaaaaaaaaaaaaacaaaaaaaaaaaaaaaaagaaaaaaaaaattggggggcattattatggggggtgcggggaaaagggggtatttagattgggccttgggtcattaggttggttccttggacccagttttttttggtccaaggggcgaagatcggcggggtcccccttataggggggccgaataaatgtcg

SEQ ID NO: 405920 - DNA, 1957 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactggtgaggggcctggcccagttcgggccctttttggggttggggggtgcactgccctccgtgtggagacctggctgaccagctccttccccagggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405921 - DNA, 1857 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatatttttaaataaagtttcctttgttgtaaaaa

SEQ ID NO: 405922 - DNA, 1607 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggcttcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgta

SEQ ID NO: 405923 - DNA, 1088 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatacaggcgcctgacacaaacgtgcggccatcgggggccagggacgtcgacg

SEQ ID NO: 405924 - DNA, 994 bp, Homo sapiens
ccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgcgccacacaaagagccggtacc

SEQ ID NO: 405925 - DNA, 601 bp, Homo sapiens
ataactgctaacgtttatttaatgttcactgtgtgccaggcactatcctaaatactttaataggtatcattaaatgaggtaggtcttacaattaagtgtattttactgatgaggaaacgtgaacagagaaattaattaccttgcccaaggaaaagtagctttttatgcagcagggccaaaatccttgtttctttccttctgttccagctccttcatgaccaagtaggggtaatccagtttggcccctacaagcaactgttcctacagacatacgcccgaggccgcacaacctatcaggctctgccctgcctaccctccatgtatggctatcctaatcgcaactggtaaggcccttttctctttgctttcatctgttccaagttgtggtcgatatttcagatggtagcctcagtgacatagtcagaattctctcagagctagggtttcccagtagaaaaagatctttggtttgttactctatggggttggtttacacctgctgtcatcctcttccccagctactttaacaggagacaggagggtagctatgaggatgtttgccagaaaaggaaattgggtcctagttgcctactgactatcc

SEQ ID NO: 405926 - DNA, 423 bp, Homo sapiens
  misc_feature (69)..(69): n is a, c, g, or t
  misc_feature (76)..(76): n is a, c, g, or t
  misc_feature (89)..(89): n is a, c, g, or t
caggtagttgcgtttcttctcaggtagttgcgtttcttctgagatcataccacttcattccagcctggntgacagngcaagactctgtntcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405927 - DNA, 411 bp, Homo sapiens
gaaaaacaacaccaaccagttgtcttgaacaacctgactccagccagccctacggaagttccttttatgcattggaggaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405928 - DNA, 609 bp, Homo sapiens
cccgagtaggtgggactacaggcgtgcaccatgattcccagctaattttttttgtatttttagtagagacagggtttcaccatgttggccaggatggtctcgagctcttgacctcgggatccgcctgccttggcctcccaaagtgctgggattacagatgtgagccaccgcacccagccgattttcaatggaattagactaaaagctaggagtaattgaaagtataggaagttcttcaggaaatctatatagatgcagatgctttgcagagtccttggttttgagtcacattgtccttcaacctgttaacacgaccctggggattctttagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattggtgaggccctcaaactaaggatgggaagaggggttcttgggggaaggaggaaggtgaattaaggagaaagagaacttaagagaaaaga

SEQ ID NO: 405929 - DNA, 589 bp, Homo sapiens
ctatgtaggaattacattaagtattttatgtaattagaattacattaagaaattggggtttacattaattagagggtgcaattgatgtagatcaaagcctgagacaagggaaatagatccattcatgtttgcacatctctatctatctcaggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactgggtaagttaattatctgggatacagaatgggagaagacagcttcctgaaatcactgtcttgtcttgagatgtaactgaagtcctccatgaattttcttcatggaaaagccttacctggcatatatgtgcaaggggcatcagaacattcttttttcaacttttttaaaattgagaaatctaaaacaaatatagacaattacattaaaaaaaaata

SEQ ID NO: 405930 - DNA, 576 bp, Homo sapiens
tcatttctttctttctttcgtggtgggtttctttctttctttctttgctttctttctttctctttctttcttttttctttctttctctttctttttttctttctttctctctctttctttctttttctttcttctttctttctttccttcagacagagtgagactccatctcaaaaaaaaagaaagaaaaaaagaagcacatgtttttcatagggtatatatgaggacctaaactgctgtgaaaatgatagaaagcaagtagctcccttattctgtttttgattgcagccttttatcttttgctaattatagcaatatttattgagcacctgccatgtgactgtcactgttctagatattttacatgtaatatacagataaaagaatagtactttatatatattacaatgatacaatgattacattaacaatacaatattttgcttgtcatatgctaagaataattgggtagagtgacattactgtgccttcgattaaaataagtacttttttgcgtgttaaattcatgttttcaataaataataaatgcatatagttgaaaaatcagtaaatata

SEQ ID NO: 405931 - DNA, 478 bp, Homo sapiens
ggtacctgcagctctctctgatgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggtaaggcccttttctctttgctttcatctgttccaagttgtggtcgatatttcagatggtagcctcagtgacatagtcagaattctctcagagctagggtttcccagtagaaaaagatctttggtttgttactctatggggttggtttacacctgctgtcatcctcttccccagctactttaacaggagacaggagggtagctatgaggatgtttgccagaaaaggaaattgggtcctagttgcctactgactatcc

SEQ ID NO: 405932 - DNA, 578 bp, Homo sapiens
gtgttaaccctacctaccttctgttgaataatttgacttctactatggcttactttttaaaactgtttgttcaaagctgagctagggaagttgccaagccttaaaggaagagaatacaatatttattcattttattcctgattataaaagtgatgagtatatagtgtaaagattggataagtaggaggtgtgggggtgattcctttcttccttctattcttatgcctcttccctgttttctcctttttctatatatatctctagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatggtaagtgttctttttgtctaccccactctgcttccagctctcctcacccgcatcataactcctcttcaagtttttcacattccatccccaagccatggccacatcactcatgtctgttggcaggtgctgctgacaattgcatcagaggcgaccatggtgtgaaatattcat

SEQ ID NO: 405933 - DNA, 366 bp, Homo sapiens
ggatcgacatagtttttaccttgcaaacttcttaaaataatcttggagctccttcaagaccagactgagatttctgcattaagttataaaagttttcgggcgggcgcagtgggtcacacctgtaatctcagcactttgggagaccgaggccagaggattacttgaggccaggagtttgaaaccagcctaggcaacatagcaagaccttgtctctaccaaaaaaaaaaaaaaaaaaaattagctgggcgtggtggtgctcacttgtagtcctttgggaggccgaggtaggagaatcacttgatcctggaagtttgagacttcagggagcaattaatatgattgcaccactacactccagcctggatg

SEQ ID NO: 405934 - DNA, 5021 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405935 - DNA, 5158 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttctaaaaaaaagcacacaaacaagaaaaacagaaaaagaaaaaaaacaacacaaacaaacaacacaaaagagggcgggcccaaaaaaccacagaggaggacaaaaaacagacccactttacaaagaggcccaaaagagaa

SEQ ID NO: 405936 - DNA, 5589 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttctaaaaaaaaaaaaaaaaaaaaaaaaaaaaaaaagaacaaaaaaaaaaagaggggggggggcgagcataaaaagataccaccgacggagcgccccactgatagcgcgtaacccagcatttttcgttgtcagaagcggggtccccacatgagagagaggaggcaaataaaaacgacgagacagcggggcacagagtatacacacacggcggcgacgggggggaacagaccgcgccgacgacggtgagacaacccctcgtggggagaagggagacccactatgaacaacgggggggggggagagacagaaagtattgttgggggagacagaaaacttctatactatggaaaggaagaataatattaaagagagcgcttctgacaagagggcgcggaacaactaattataaacagacgttttagcaacaggggtggagaagaaggtggtggtgtaaaacaaaaaaagcaggggagaaaaatatcactatagtagggacgatgaaagaagttttaggaggacataagcgggaggatatgagtttttgcgagaatgattttttattccccggaga

SEQ ID NO: 405937 - DNA, 4829 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaactctgtgtactcagaaatttgaagaagttatttggttttccaaaatgcacactgcgggttattgatttgttctttacaactattgttctcatatttctcacactaaataaatctctatgagagcttct

SEQ ID NO: 405938 - DNA, 4660 bp, Homo sapiens
atccactgtcgctactgtatcctaataaaataatattcccatcctagagttaaaggtagaagagtctttcacaggatcttaatttacatgattaactgtatataaatacacacacacacacacacacatatagaagtaaatgtaaatgtatgtttcactatctgcctctgagaatgtattgtgcctctaactggcttccattcttaagtcttataggtgaaagtgccgaagttgagaaaagctgttagagtggtagagaaaaggagacagctaacctgatagcaaaagcagcagcccctttgctaatgtagctgagccgttaagcaatgcagttctttagagaaaaatgattacaagaacctgatagaacagatttgtttaatgtttaaagcctttgtctggaatatctttcaggaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405939 - DNA, 4010 bp, Homo sapiens
acggattagagatacgagtgatctattgactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405940 - DNA, 5048 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgaacactcatgccctttgcctcttacagccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405941 - DNA, 3621 bp, Homo sapiens
tagaggattcttgcgacgacagtgtggacgggaacggcagctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405942 - DNA, 4874 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405943 - DNA, 3671 bp, Homo sapiens
agctatgcataggtcgcgcctgggttgtaatttccttcacgggctcgcgcgatgcttatatagatgggcagtgcgacacataatgtaaaagaacctgagtacattacgcactagctggatttccatagcacgcatccataatcattgtacgctaggtagtgcaggatcgcgccaggtctctccctaatattgacgtcgatataaatattctgcataagcctacgcgattagccatgactagtaagatgagtcgggtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405944 - DNA, 2783 bp, Homo sapiens
aatataacaagagaagccgatgttaataagagacgaggatcacacaaaatattatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405945 - DNA, 2909 bp, Homo sapiens
cccgagtaggtgggactacaggcgtgcaccatgattcccagctaattttttttgtatttttagtagagacagggtttcaccatgttggccaggatggtctcgagctcttgacctcgggatccgcctgccttggcctcccaaagtgctgggattacagatgtgagccaccgcacccagccgattttcaatggaattagactaaaagctaggagtaattgaaagtataggaagttcttcaggaaatctatatagatgcagatgctttgcagagtccttggttttgagtcacattgtccttcaacctgttaacacgaccctggggattctttagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405946 - DNA, 2392 bp, Homo sapiens
tatgattaggagtgactggacgaggggtcgtgttagcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405947 - DNA, 1819 bp, Homo sapiens
gtctctctctctctctctctctctctctctctctctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405948 - DNA, 3998 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacaggtagatggaactccttcagtgaccatagggaagccagatcagctcttacatggagggagcagaccaaggtccttgcctctgaaacaaagcaataaataacaacattcaacaa

SEQ ID NO: 405949 - DNA, 3683 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggtaaggcccttttctctttgctttcatctgttccaagttgtggtcgatatttcagatggtagcctcagtgacatagtcagaattctctcagagctagggtttcccagtagaaaaagatctttggtttgttactctatggggttggtttacacctgctgtcatcctcttccccagctactttaacaggagacaggagggtagctatgaggatgtttgccagaaaaggaaattgggtcctagttgcctactgactatcc

SEQ ID NO: 405950 - DNA, 1153 bp, Homo sapiens
tggtggtcctttttttcttcttgtgcttgtcccctgctccctgaggcagtgacactggagaaagctagagcatctccccactgctcttggccagtcagtgatgaacaccccaatacctgtctactgtgcccattgaggggtatagggaatacattttctagggttctcaatcttacaaatctctaacttgttcctttgtttgtttttccacaggtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405951 - DNA, 977 bp, Homo sapiens
caggcacttttttaaaagacagaatattctgaactgagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405952 - DNA, 976 bp, Homo sapiens
cctagttttagaagtttcaatagcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405953 - DNA, 893 bp, Homo sapiens
gcaccttctctggggggaacatatggtgactgacccatgcacacaaagggggccttagcgaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405954 - DNA, 2792 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgaggtgagaggaatatggtcatcagccccatattgtcttagaggtgagagagttagagtgccattgggagggcattattctgggcttgcttctttagccagaataatgaaatttgggattttttttagttgttacattgagccatcttcctgttgctatttgcccatctctacttttacctgcctctgcttctgccaccgcatttctatttttgtcaacctcaattagtgtgaattcagtaacttctaggataaaagcaagatggcatggaatttgaaaatcttattatttccttgacacttgatcttgctgactggctacttagatgaaagagtacctactaagcgttggg

SEQ ID NO: 405955 - DNA, 2104 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttgaaaattacttggttgaagtaaaaaaactgtcccatcctttatcctgtgtgccataataaaatagtaaaaaaccta

SEQ ID NO: 405956 - DNA, 1599 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggaggtaaatcggacttgtttctttcctccaaaccctctcatctgtcaccctgatacaact

SEQ ID NO: 405957 - DNA, 683 bp, Homo sapiens
gtgactctagtggatcccgagtgtcttcaagaagtgattcaaattgctgctcagattttaaaacttacttgtaactatcagtgtaaagacccatgcctggatccctgtatcatttagatatcaacttggtaaaaatgctgtgcttgacaccctgtcctctctatcctccctcaaaccacatgtgatctctgaaaaaataaaattagccaagtgtggtagtgcacgcctgcggtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405958 - DNA, 1107 bp, Homo sapiens
  misc_feature (1080)..(1080): n is a, c, g, or t
  misc_feature (1093)..(1093): n is a, c, g, or t
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgnacagtggtctggntcctctagagtcgc

SEQ ID NO: 405959 - DNA, 1123 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggacacatcacataatggttgtgccctgttaacacacaaacacaggttctagattaccagttccacactcggatggtctgagtcgac

SEQ ID NO: 405960 - DNA, 1494 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtacagagggtctgtcataactgagaataaaggacagaggatgtgggaaggtttgggaatcatgaaaggaactgaaagacaggaaatttcattcatacagagctcaggcctttgacaacattatccggagaacttactcagcaaacatttattgaatgcttactgtgtaccagacactgttttcttttttgggaattcaaaaataaataagaaatggcttctgttttcaaggagcttttattctaatagagaagataaacatatatccaagtaatagcatgtacagtttggtaagcaatataatagagagatattcacagtgaaataggaaagagcagtataggtgcaaagacaaaaagcatgacacagctagatacagggcagctgttattggttttgtatggagaaaacctggagaaatggtgagagaaggggcagaagatgagaggggccagatcatggagtacctgtttgtggcgctcaggagtttagatgttatcatgcagataactaggagccatttgaggaacttaaatacaggagtgataccagatttatatgtttttaaaatgattacttggtggtaattaaagaaaagattggatgatttgggcaagacaggaggcaaaaataccagttaggaaacctgagcttaggtagtaggcaaaaaaaaaaacacaaacaacacaacacctgtgtgggggcctggggcccggaaaagggtttcaagaacaatgttggggcggggggcccagggcaggcaacccggacaaaggcgtccccgagaacccgggccaaga

SEQ ID NO: 405961 - DNA, 336 bp, Homo sapiens
aaaatatgatgaaggtatgaagtgaggatgcaaactagagtattaagagaggcagcactctttttttttttcttttcctgtaagtgatgtctacttcttgcccgactccaccccaaatgtctaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgaggtgagaggaatatggtcatcagccccatattgtcttagaggtgagagagttagagtgccattggg

SEQ ID NO: 405962 - DNA, 691 bp, Homo sapiens
ggactataaccagttccgttctgttccttccctctgtagggaagggaggagcactggctgctgacattgacattgacactgttggtacagagggctggggagaggatgcagagctgcagttggatgaaggtaaaagtgctgttttaagactgttctggggtgatggacaccttggattgggactgggttgtgggtagctctgcagacttccaggccatgaaacgaactaggattgattttacttcctttggctaagattatgccactgcccaaatctgttttgagcttgaattttccttacagatgggtttgtggaggctacagaaggtttgggggatgatgctcttggcaagggacaggaagaaggaggtggctgggatgtagaagaagatctggagctccctcctgagctggtatgtggaatttgtacccttagaaggttctctccgtatctccctgtggaagccagaggccttattgtcccctaccactatcctcaggtctcctatcctatcccctaccactatcctaaggtcagcccttctgggaaggggactagaccctcctagtctgatgcttatctcccatttgaaagaaggaagatggctgggcacggtgactcatgcctgtaatcccagcactttgggaggctaaggcaggacaattgcttgagcccaggagttcaagacca

SEQ ID NO: 405963 - DNA, 360 bp, Homo sapiens
gtctgttaatttgtggagtagagagcatttcttactttcattcagataatatctgcatctttggaggataaagaaaataaagtgacatcagtgctgatgtgtttggcaaagagccctataactcatagatgtagaaacagtcaaatgccctctgggtgaagggtaagaaaagtatggtttcagattggtgtctgtgcaatggaactgttttctctgtcagagtaaattggaaaactggtatcttgggtgcttctcactaacattttaatttccccttttcttctacaagagctagcaatctagagaatagtacctatgacctgtacaccatccctaaagatgctgactcccagaatcctg

SEQ ID NO: 405964 - DNA, 250 bp, Homo sapiens
agtgtagtaagaaggaagtgtaaataagaaatacttccttttctcaacaatcttatagactccaaaaaggctaaattgtctttacatgttactttctgctttgcttgctgagacctgggaattttttgaaactggacagaaagaagtcagacaataaaataatattcccatcctagagttaaaggtagaagagtctttcacaggatcttaatttacatgattaactgtatataaatacacacacacacac

SEQ ID NO: 405965 - DNA, 5042 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaaaaaaaaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405966 - DNA, 5712 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgacttggccatttatttcttggacactctcatgttcttgttcacccatgcaggcaccccaccaaagtacatatcttccttccagtaataatttttaattacaaaataaacatccactattggaaaaaaaaaaaaaaagctagccgggcatggtggtgggtgcctgtaatcccagctactctggaggctgaggcagaggattgcttgaacccgggaggcggaggttgcagtaagctgagatcgcgccaccgcactccagcctgggcgacagagtgagactccatctcaaaaaaaaagaaagaaaaaaagaagcacatgtttttcatagggtatatatgaggacctaaactgctgtgaaaatgatagaaagcaagtagctcccttattctgtttttgattgcagccttttatcttttgctaattatagcaatatttattgagcacctgccatgtgactgtcactgttctagatattttacatgtaatatacagataaaagaatagtactttatatatattacaatgatacaatgattacattaacaatacaatattttgcttgtcatatgctaagaataattgggtagagtgacattactgtgccttcgattaaaataagtacttttttgcgtgttaaattcatgttttcaataaataataaatgcatatagttgaaaaatcagtaaatata

SEQ ID NO: 405967 - DNA, 5082 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttctaaaaaaaaaaaacacaagacaaacaacatttgtgggcccaggccccaaaaaagtttaaaca

SEQ ID NO: 405968 - DNA, 5520 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaactctgtgtactcagaaatttgaagaagttatttggttttccaaaatgcacactgcgggttattgatttgttctttacaactattgttctcatatttctcacactaaataaatctctatgagagcttcttgacttggccatttatttcttggacactctcatgttcttgttcacccatgcaggcaccccaccaaagtacatatcttccttccagtaataatttttaattacaaaataaacatccactattggaaaaaaaaaaaaaaagctagccgggcatggtggtgggtgcctgtaatcccagctactctggaggctgaggcagaggattgcttgaacccgggaggcggaggttgcagtaagctgagatcgcgccaccgcactccagcctgggcgacagagtgagactccatctcaaaaaaaaagaaagaaaaaaagaagcacatgtttttcatagggtatatatgaggacctaaactgctgtgaaaatgatagaaagcaagtagctcccttattctgtttttgattgcagccttttatcttttgctaattatagcaatatttattgagcacctgccatgtgactgtcactgttctagatattttacatgtaatatacagataaaagaatagtactttatatatattacaatgatacaatgattacattaacaatacaatattttgcttgtcatatgctaagaataattgggtagagtgacattactgtgccttcgattaaaataagtacttttttgcgtgttaaattcatgttttcaataaataataaatgcatatagttgaaaaatcagtaaatata

SEQ ID NO: 405969 - DNA, 4519 bp, Homo sapiens
ctttaaaagggataccctactaaaatctcacagataatttacagtatggattactgagattacatttattttgatattttaaaatatttttgagagaagagctatgtaatcttagtcctcctgaaattagtaatatttaaatactaaagcattagaggcaagaagagaactattgttaaaatagctgactgggcttattattattagttcagaattggtaggatgacctgcctttgtctccataaaagtaaaactggataagcatttattgaatatggagaaaggtatttagtttaggagtctgttgacttccacctctaatttggtattgtcttttttttttcttgcagtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405970 - DNA, 4006 bp, Homo sapiens
acggatgtgagaggatacgggtagactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405971 - DNA, 3629 bp, Homo sapiens
agatgatgtatagtgcgggcgggtggtgattcggccgaggggcgggccttatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405972 - DNA, 4981 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405973 - DNA, 3364 bp, Homo sapiens
tcggaccaattcagagccacgcgggatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405974 - DNA, 2783 bp, Homo sapiens
ccagtaccctagggttctacggtcgcgaggctgggtggcgagaaaatatgactgacgggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405975 - DNA, 2470 bp, Homo sapiens
  misc_feature (16)..(16): n is a, c, g, or t
tgccagctcagacttnctgttttagagaaagggtcttgctctgttgccctggctagaatgctgggattatccgtgtgaaccagcgtgcctggcccccatctcagttatctggaaatagtttccaacaaacgggtgcaacgtgcaaatttcacatcacggggatgcacctgtctgtgcaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405976 - DNA, 4181 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagaaccctctaaatccccttgtaaataaaaaaaaaaaaaaaaaaaaaaaaaataaaagcatataaaaaaagggggggggaggcataataataatatttccttcggggggggccaaagtatatatggggttacccaggtttttttcgtgaccaaggggggcctcaatatataggggacgggagtttttattaagcaagggaaagtggggggggcgtttaaaaacggtggggtacgggggaacaaaccgcttaccgtgggactctttgggagaaggaaccttaatcggggggggggaca

SEQ ID NO: 405977 - DNA, 1939 bp, Homo sapiens
ataactgctaacgtttatttaatgttcactgtgtgccaggcactatcctaaatactttaataggtatcattaaatgaggtaggtcttacaattaagtgtattttactgatgaggaaacgtgaacagagaaattaattaccttgcccaaggaaaagtagctttttatgcagcagggccaaaatccttgtttctttccttctgttccagctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttct

SEQ ID NO: 405978 - DNA, 2346 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactgggtaagttaattatctgggatacagaatgggagaagacagcttcctgaaatcactgtcttgtcttgagatgtaactgaagtcctccatgaattttcttcatggaaaagccttacctggcatatatgtgcaaggggcatcagaacattcttttttcaacttttttaaaattgagaaatctaaaacaaatatagacaattacattaaaaaaaaata

SEQ ID NO: 405979 - DNA, 1856 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatggtaagtgttctttttgtctaccccactctgcttccagctctcctcacccgcatcataactcctcttcaagtttttcacattccatccccaagccatggccacatcactcatgtctgttggcaggtgctgctgacaattgcatcagaggcgaccatggtgtgaaatattcat

SEQ ID NO: 405980 - DNA, 2286 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagaggtacttatctttatagccaggggctgaatatgggctgtcatcttgggaaagtcacagtatgttgttcatttattcattccttcaacaaatatttacagagtgcttattaagtgccaggcactgtttgaggtactagaaatcaaattgtgcgtgaaccaacagagaaatgaagcttatgtgccacctgagggagagtcttattaccttataaacccagtgggaaagggagaaagccaggcgtagacctcatcaccatcccaaagcagagcccattctcaagctttctgtaaggcagggcagcaggaaatttaatcggagttatcgagaaccagccatgtgtaacttttgtgcaggtgggaaaacagaaaagcataagggaaagaaactagtttttgttctaaaaaattatctaatcttcatagctacccactgaagtagatattattatccctatttagcagacaaaaaaaaaaaagagatttagagaaattaagtggtctaccaaaatctacatatatctagtaaataaatgtaagaaataagatttgaatttcgatctgactccaaaacccaggtgcttttcgctgcatcatgatacatctcaataatactgctaattcaaaactgccttatccaggattctgtcacaatataccatataactgtataaatagggtatacagtatcttaaaatcagcagttcttaaactttttggtctgaagatctctttatactcttaaaatttattgaggaccccaaagagtttttgtttatgtgggttatatctgtcaattttttaccacattttagattaaaacaacttttaaaaacatgaaatatatcagcacacattctattagctgtcagagcgatgatatcacatatcatgtgctgggaaactctattgtatacttacgaaagaataagaatgaagaagataaataggctgggtgcagtgggtcacacctgtaatctcagcactttgggagaccgaggccagaggattacttgaggccaggagtttgaaaccagcctaggcaacatagcaagaccttgtctctaccaaaaaaaaaaaaaaaaaaaattagctgggcgtggtggtgctcacttgtagtcctttgggaggccgaggtaggagaatcacttgatcctggaagtttgagacttcagggagcaattaatatgattgcaccactacactccagcctggatg

SEQ ID NO: 405981 - DNA, 1031 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttggtaaagcaggaggcagagggctcgaaaagagtcttcatttttcctagtttttcataatgagcttctcttagaacaatcttctcccttctcaaatggactatgtcggctgattaattactgattgtatttgtaggatgcttttaagtgcaaaataataaatgtagaggcaatcccataaa

SEQ ID NO: 405982 - DNA, 2578 bp, Homo sapiens
cccaggaaattgtccacctggctccacgggcctgggagggctgtgtgcatgggatggcaggtttacgaggaggagtgaggcctcctgccggagccccacctgcattcagcctgaggccaggccccccacctactctaactaccctgctgagaccaccccactactcacagacctgttcaagaaaaagttgtcctcagggtctctcacacactgggaaatctacttgaaatgtaaacattactttttctcatttttcataaaaggcaacaggctgatgttcatatatttctcttgaatgcggattcagtttcactcattgccctgtcttggaaatccccacgttaatgatggcttaaattaggttgatagagtcctcccttggagtccagcttggaaaatcctcactggagaggggcaggcccacttctctttttggaagatggttcctaactaaagaaagagggaccagattgggcccctggccctgcagtgcgtcccaatttatctgacgtagaaaccgggatttggaaaataccatcctggctttttctctggacttcacaatctagagggcgaggactgtggcccagtcaccttcccacacagtgcacagtagaaactccagacatgctttgtggagtggaaacatttccagtggcttctgactctagttcctgatgtggtttaaactaatttgggcagccatggcagcagaggccaggaacagtattcaatactttctgaacttgtgattctcccccaacctgatttgcatgaagctactttggaacatttgtatctgcgtaaaactaagagacctcagtacacccaatcccctcttccaacacatgtgaggtttccatgtgaaagtactttttcataggttacaataaattgcttgcagttacaaatttggaggtgtttcagcttgtattgtttcacgaggaatttcttaggggcacttggcctacaccctgtttttgttctagaattacctgccgttaaggtcagataaattttcagtaaacagattatggcacaaatcaatgtgtcctttcccggacagaagagatggctctctggccatgtcctaacaccagactgtccttatttaagaggcaggcgtgtcttttgtctaggttgtcttcaaatttaacccattaaaccagttaaccttatttcatatgtgaagggctttgatgtggacaagatgaggcacaaacttttcatataatttccacatttttagcaacaggttttttttctccaacaacagttttcatcataaaaggtgactaaaccagcaaatgagaagacaaataacattgaagaacatgagctattgaaacttactttttattattttttccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405983 - DNA, 771 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccggggtgagttgctccaaacctctgtccctagccccgaggtgcccagggcctagtgggcgggagcagaccaggtgcgtttcctaacacctgggttctgccccgtccacgctacagaggagcaagatggatgttgctgtggtcttgaggaggatgaaatagtttgatttagtttttacagttaagcaacgatgtttcctcagattcccgtagttacctcaatcaactccttgatcttaacttggcatctttctcaaccggcgacagcagaaactcttggatagctctatgccatttttgttcagttcccatacgttgctatttaatccaataaaagtctgattcacagtttttacacatttaaaatagcaacaggaacaactaaaaaaacatgttgtgggccgccctgggccaaagaatttttaccaccacccggtggggcgcggcccatagggtgcggacagggcaaacgtccacaggaaaccggccgcgacaggctggtttcccccgaaaacgcggggccgggttgacaccgggctgggcatggcctcacgtcggccattc

SEQ ID NO: 405984 - DNA, 572 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccggggtgagttgctccaaacctctgtccctagccccgaggtgcccagggcctagtgggcgggagcagaccaggtgcgtttcctaacacctgggttctgccccgtccacgctacagaggagcaagatggatgttgctgtggtcttgaggaggatgaaatagtttgatttagtttttacagttaagcaacgatgtttcctcagattcccgtagttacctcaatcaactccttgatcttaacttggcatctttctcaaccggcgacagcagaaactcttggatagctctatgccatttttgttcagttcccatacgttgctatttaatccaataaaagtctgattcacagtttttacacatttaaa

SEQ ID NO: 405985 - DNA, 734 bp, Homo sapiens
cggcacaggtagggcgccccgcagacccggacaacgctgggtgtggctgaaaacagggagtcatggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttcggacacaaaaaaaaagaaacaaactagcaaaacaaaacaactttgtgtgcgggccgcgccttgggccttgagaaaaggtttttaaaccccttcgtgttggggccgcgggggccccaatggggtaccgtgaacaccttggggcaaacggttgtccacaaggagaaactccggggccaggcacaaggggtggggtttctccccaatgaaaag

SEQ ID NO: 405986 - DNA, 1068 bp, Homo sapiens
ggacaaagcctcagtccttccttaaaatgttgactgctaccttgatttacaattcgtaccttccctactttgctgcatttttccttttcagcacctccccccacttttaaaaaactaatttgctcttctctgggctttcccctgcagccctctccacaatagatgattgtcccgcacagatgccgtcctgccacgaaggctcttagcctttctggctgctccgcccgccgctcgccaagtgaggacagagggtctttctctggggtgtgctttatttcatatgtgctcagccggcctaccctggctcttctaatacatattaatgcttttctctccctgacttatgaggacaggatcgtttgatcatttcttgttttgaatgttctttttgtgctgacagagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaagcacccttcacaatagcaaacgtaaacgatggaattgatggaatcaaccgaaattgacggaatcaatctaaatgttcatcactgacagattgtgtaaagaaaatgtggaacatggacaccatggaatagtatgcagccataaaaagaatgagatccgatcttttgcaggaacatgcatggagccggagacagttatccttagcaaactaacgcaggaagagaaagccaaatactgcatattcttacgtataagtgggagctaaatgataagaacttatgagcacaaagtaggaaaccacagacagtggcatctccttgaggatatagggtgggagcagggagaggagcagaagagatcactattgggtactgggcttaatacctgggtgataaaataatctgtataacaaaaccccgtgacatgagtttgcctatgtaacaaaccttcacatgtacccccgaacctaaaataaaagttaaaaaaaaattagggctattcaattctgcattaagcctcttgtcagccattg

SEQ ID NO: 405987 - DNA, 812 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccggggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgagagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggcaagtctaataagatgcaaataaaagtgtctttcttttttttttcttttttcttctgagtatttattgggttattcttctataactaaacttggtttttcaaacacacaaagtgaattatcaatctggaggtatcgact

SEQ ID NO: 405988 - DNA, 979 bp, Homo sapiens
ctgcctgttgcaaagatgagataaaggcgcgggaaagaagggtctgaattaggggttgagctctgaaatcggacgattctgtgtttcctgccgcatggagggcgtgtgtggttcgcaggctgtggggggtttcttgcagcgggggctgctgcctaaacagactccgcgggccccatgatggcaaaccccctcgccccgttcatgacttaatgcctcctagaagaaaaggctaaaaacaagacacacagaacaagaaattgcactctctcaaaacgacagtcgccctgaaacggacgctggaagaggtttccaggcccgtggcgacggctaaggcagctggataagcacagccaggccacagcccagcagctggtgcagctcctcagcaagcagaaccagcttctcctggagaggcagagcctgtcggaagaggtggaccggctgcggacccagagacaaaatctggctctgtcacccaggctagagtgcagggatgtgatcatagttcactgaagcctcaaaactcctggcctcgagcaatcctcctgcctcagcctcctgaagcaatcctcctgcctcagcctccttgagcaatcctcctgcctcagcctcctgagcagctatgaccacaggtgcacaccagtatgcccagctaatattttgttatttagagatgggatctcactatgttgtgcagactagtctcgaactcctctaccttggccttcaaaagtactgagattatagttgtgagctactgtgcccagtcctagtttcttaagatagaagctaaggtcattaattttacacttttcttcttttctaatgtttaaaaatatcttttagtactataaattgtatttagtactataaatttaagtattgctttagctgtatatcacagctaaacacattgtgttttcgttttcagtccattcaaaatactttctcatttccctttgatttcttctttgatcca

SEQ ID NO: 405989 - DNA, 618 bp, Homo sapiens
caggacaacgaactgctgtctagtatcaatgtacaccttgtgggtaggtctgatgagctgtgtaatcagtggtgctttactgcggagttcggttcatcccgcagcgccagttctgccccgtccacgctacagaggagcaagatggatgttgctgtggtcttgaggaggatgaaatagtttgatttagtttttacagttaagcaacgatgtttcctcagattcccgtagttacctcaatcaactccttgatcttaacttggcatctttctcaaccggcgacagcagaaactcttggatagctctatgccatttttgttcagttcccatacgttgctatttaatccaataaaagtctgattcacagtttttacacatttaaattatggcacagtggattgaatgtgatttatgggatcagtggggggaaacactaataattattttaatcacaagagcccccttttaattgatttaggctatttacatacagtaaatcatctgcagcttacaccaatcgtgtgaatattttacacatggggaaagcgaagctcagagaggttgaattacaggccagagcccacacagctggttagttgcagagccaggtattatcaggct

SEQ ID NO: 405990 - DNA, 3464 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405991 - DNA, 3323 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactgaactttttgatcatctcaaacaaaaagtctggacgtattaaacaatatctccattcccctccctgccaacccctgatgacctctcttcaactttcggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405992 - DNA, 3337 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405993 - DNA, 2472 bp, Homo sapiens
cttccctcggtctgggcttctctgaggcggcgagagatggtcaggtctggagctcgaccgggccaggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405994 - DNA, 2789 bp, Homo sapiens
ggacaaagcctcagtccttccttaaaatgttgactgctaccttgatttacaattcgtaccttccctactttgctgcatttttccttttcagcacctccccccacttttaaaaaactaatttgctcttctctgggctttcccctgcagccctctccacaatagatgattgtcccgcacagatgccgtcctgccacgaaggctcttagcctttctggctgctccgcccgccgctcgccaagtgaggacagagggtctttctctggggtgtgctttatttcatatgtgctcagccggcctaccctggctcttctaatacatattaatgcttttctctccctgacttatgaggacaggatcgtttgatcatttcttgttttgaatgttctttttgtgctgacagagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405995 - DNA, 1897 bp, Homo sapiens
  misc_feature (20)..(20): n is a, c, g, or t
  misc_feature (23)..(23): n is a, c, g, or t
  misc_feature (38)..(38): n is a, c, g, or t
ccccccccccctttctctgntanccctttcaggttctngatttaccgatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405996 - DNA, 2259 bp, Homo sapiens
catccgcaacgaaagtcaagaaatgcaaaaaggaactgacacatctcagcaaagaaaactgaagggatttggttataagtggagaggatctcagcatatttctggaagatagaaagtggatgaagcatgataatgaaagagagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405997 - DNA, 1919 bp, Homo sapiens
caccccgcccgcaaccgacaaaccaaaatttagaaataaaaaaaaaatttaggggaaacaagaaccgagattttgaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 405998 - DNA, 2590 bp, Homo sapiens
  misc_feature (327)..(327): n is a, c, g, or t
  misc_feature (329)..(329): n is a, c, g, or t
  misc_feature (331)..(333): n is a, c, g, or t
  misc_feature (336)..(336): n is a, c, g, or t
  misc_feature (338)..(338): n is a, c, g, or t
  misc_feature (345)..(345): n is a, c, g, or t
  misc_feature (348)..(349): n is a, c, g, or t
  misc_feature (352)..(352): n is a, c, g, or t
  misc_feature (354)..(355): n is a, c, g, or t
  misc_feature (362)..(363): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (380)..(380): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (1000)..(1000): n is a, c, g, or t
  misc_feature (1087)..(1087): n is a, c, g, or t
  misc_feature (1172)..(1172): n is a, c, g, or t
  misc_feature (2247)..(2247): n is a, c, g, or t
  misc_feature (2366)..(2366): n is a, c, g, or t
  misc_feature (2392)..(2393): n is a, c, g, or t
  misc_feature (2424)..(2424): n is a, c, g, or t
  misc_feature (2507)..(2507): n is a, c, g, or t
  misc_feature (2557)..(2557): n is a, c, g, or t
  misc_feature (2567)..(2567): n is a, c, g, or t
  misc_feature (2570)..(2571): n is a, c, g, or t
ctgcctgttgcaaagatgagataaaggcgcgggaaagaagggtctgaattaggggttgagctctgaaatcggacgattctgtgtttcctgccgcatggagggcgtgtgtggttcgcaggctgtggggggtttcttgcagcgggggctgctgcctaaacagactccgcgggccccatgatggcaaaccccctcgccccgttcatgacttaatgcctcctagaagaaaaggctaaaaacaagacacacagaacaagaaattgcactctctcaaaacgacagtcgccctgaaacggacgctggaagaggtttccaggcccgtggcgacgntnannnggntnaaggtcncanntgnanngcacggnncggcgnctncgnagccngggnagnagncgncgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaaggcgccctcctcccttgggaagtccgccgtcctctgccgtgaagattgcccctctctcctccagtgcctcctccccagcggcttcggtggctcccaccctccgcaccccgtctcgcgacctccccgccagcccagcccctcaccagaagaggctttctcttccagcccctgaaatctggcttctgccccagccaggaggctccgcagggcgctccgccaccaggtggcatttcccacaaaccggccactccgccctgacccctctcctccctggacctccgtctcccagttttcctccctccaggatcccactctcagtgtcttgccggattccagtccactgccagccattgaaggcngaggttccttaacccctatcctggggcgagcccttccctctcactgcagaagagcttctcagctaggggggtcgtgcgggcccgganagctgcatttttaacaaactccccacactgacaatctttgccaacccttcccaggcaaatcttgcccccacgttcatggtctcgnctcccagcaggtttggcccacccagctagagctccagctcggcccttcctaagccccaagctgcatagctgcctggtgggtgcgtgttccacaggtacctcggactcgccctgaccccagaacgtctcttctacgccaggccgatccctcctgccatcctctgtctgttaaatggcactgccattgcctgcaggacgaagtccatatttgctggtttggctacagagtccagcgtcgccttcctctgagcagcctgcagcctctggtgcagccacactgcacagcttgcagtttccagacacgcattggcctttgcagtgcggccccgaagtgggaaggccccgcccctggccctggccagaaaagcacccactcatcctttcccatcccagcttgcccgctgagtgactttgaatcaatgattcatgttgtctgtgcctcagtttccttaaccttaaagtggcataataattagttcctgcctcatggaattgtgagtgctaaataaacagtaagtctagtgcccgacataaaagtgctcagcatacgacgatcatgagccatgtctaagcaggcgcaagccctcccaggcttctcatctgcaatattggccatttctcttcatgcttcagtgtcctgtttgagttgagcatgttttttttacaagtgagtctctcctccattggccgggaaccgcccgagagccgggagcatttgtcattcttgatggacccccaggtcttaaatcagtacttgacccttaagaggtgttgggcgggcgcggtggctcacgcctgtaatcccagcactttgggaggccaaggcgggcagctcacgaggtcaggagttagagaccagcctggccaacatcgtgaaaccccatctctactaaaaatacaaaaattagacaggtgtggtggtgcgcgcctatagtcccagctacctgggaggctgaggcaggagaatttcttgaacccaggaggcagaggttgcagtgagccaagattatgccactgcactccagcctgggcaacagagcaagactccatctcaaaaaaaaaaaaaagaagaaganccgagctggaactcatagctttcactgtacatggttgtttattttttaaatgttcttatgtttttcatagattaccctgattagttttaggatttctcttagagatttttacttttttncaaagaaatgttaacatttaaaaaannctctaatttttgctttcttgttttttgtccnattttattttattttgattttatttacgacttgattctttagtttttaaagtgatgtatttctagatcattgtacttaagggnatgtgacttattttgtctcattcagaatccagatatttcatctttaattncattaaaatnccnncttgtaatgaaaaaaaaaa

SEQ ID NO: 405999 - DNA, 1354 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggcaagtctaataagatgcaaataaaagtgtctttcttttttttttcttttttcttctgagtatttattgggttattcttctataactaaacttggtttttcaaacacacaaagtgaattatcaatctggaggtatcgact

SEQ ID NO: 406000 - DNA, 1659 bp, Homo sapiens
ctgcctgttgcaaagatgagataaaggcgcgggaaagaagggtctgaattaggggttgagctctgaaatcggacgattctgtgtttcctgccgcatggagggcgtgtgtggttcgcaggctgtggggggtttcttgcagcgggggctgctgcctaaacagactccgcgggccccatgatggcaaaccccctcgccccgttcatgacttaatgcctcctagaagaaaaggctaaaaacaagacacacagaacaagaaattgcactctctcaaaacgacagtcgccctgaaacggacgctggaagaggtttccaggcccgtggcgacggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 406001 - DNA, 1551 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccggggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgagaaataagaatcacggccgggcgcggtggctcacgcctgtaatcccagcactttgggaggctgaagcgggcgaatcacgaggtcaagagattgagaccatcctggccaacatggtgaaaccccgtttctactaaaaatacagaggcaggagaatcacttgaacctgggaggcggaggttgcagtaagctgagaccacgccactgcactccaacctggcaacagagtgagactccatttcaaaaaagaaaaaaaaaaaaagaaataagaatcactaactgctcttatagaaattatgatattcaagtaaaataatgaaaataaagcactttagttttcaaattattagtattttttctctgtagatagtcttcatctaattttaaaattgcaatgataatataatagtttgagtatttgtatacatgatgaatttgagtatatatgatgaatattcatgtactttttatagaatctatttattagagatcccagtaagacctatatattatagattaaccattagtgatttatgtataatgagtagaaaaagacagcaggaattaatatttttgttgttaaagattatttttaaatagtagtaatgaagtaattttaaatcaaataaactttgaaatattgtttataattttattttaataagtccaatttgaaattttaaaatcttccaggccatagcctatctagagacataactagagtaatactaagagccagaactcagctgattgtggtggcttacgcatgtaatcccaacactttgggaagccaaggcgggtggatcatttgaggtcaagagttcgagactagcctggccaatatggtaaaaccctgtctctactaaaaatataaaaattagctgggtgtggtggcacacatctgtagtcccagctactcaggaggctgaggcagaatcacttgaacccaggagatagaggttgcagtgagccaagatcatgccactgcactccagcctgggtgacagagggagactccatct

SEQ ID NO: 406002 - DNA, 3227 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 406003 - DNA, 3412 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 406004 - DNA, 3098 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccgagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 406005 - DNA, 2680 bp, Homo sapiens
tccagtctcatcatattcaacgtgtcaattagaatcaccacaccaaagtttcagggtcgtggtaaaaattaataaggtattggacgtaaactaaagcataaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 406006 - DNA, 2054 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactgaactttttgatcatctcaaacaaaaagtctggacgtattaaacaatatctccattcccctccctgccaacccctgatgacctctcttcaactttcggagaagctaaaacttacttatgaggaaaagtgtgaaattgaggaatcccaattgaagtttttgagaaataagaatcacggccgggcgcggtggctcacgcctgtaatcccagcactttgggaggctgaagcgggcgaatcacgaggtcaagagattgagaccatcctggccaacatggtgaaaccccgtttctactaaaaatacaaaaattagctgggcctggtagcacgtgcctgtagtcccagctacttgggaggctgaggcaggagaatcacttgaacctgggaggcggaggttgcagtaagctgagaccacgccactgcactccaacctggcaacagagtgagactccatttcaaaaaagaaaaaaaaaaaaagaaataagaatcactaactgctcttatagaaattatgatattcaagtaaaataatgaaaataaagcactttagttttcaaattattagtattttttctctgtagatagtcttcatctaattttaaaattgcaatgataatataatagtttgagtatttgtatacatgatgaatttgagtatatatgatgaatattcatgtactttttatagaatctatttattagagatcccagtaagacctatatattatagattaaccattagtgatttatgtataatgagtagaaaaagacagcaggaattaatatttttgttgttaaagattatttttaaatagtagtaatgaagtaattttaaatcaaataaactttgaaatattgtttataattttattttaataagtccaatttgaaattttaaaatcttccaggccatagcctatctagagacataactagagtaatactaagagccagaactcagctgattgtggtggcttacgcatgtaatcccaacactttgggaagccaaggcgggtggatcatttgaggtcaagagttcgagactagcctggccaatatggtaaaaccctgtctctactaaaaatataaaaattagctgggtgtggtggcacacatctgtagtcccagctactcaggaggctgaggcagaatcacttgaacccaggagatagaggttgcagtgagccaagatcatgccactgcactccagcctgggtgacagagggagactccatct

SEQ ID NO: 406007 - DNA, 1919 bp, Homo sapiens
  misc_feature (16)..(16): n is a, c, g, or t
  misc_feature (64)..(64): n is a, c, g, or t
cagagacccgcacccnacgaatatactaacatgtattaaaaatatattataaataattttaggngaataaccacgaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaa

SEQ ID NO: 406008 - DNA, 1743 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaagcacccttcacaatagcaaacgtaaacgatggaattgatggaatcaaccgaaattgacggaatcaatctaaatgttcatcactgacagattgtgtaaagaaaatgtggaacatggacaccatggaatagtatgcagccataaaaagaatgagatccgatcttttgcaggaacatgcatggagccggagacagttatccttagcaaactaacgcaggaagagaaagccaaatactgcatattcttacgtataagtgggagctaaatgataagaacttatgagcacaaagtaggaaaccacagacagtggcatctccttgaggatatagggtgggagcagggagaggagcagaagagatcactattgggtactgggcttaatacctgggtgataaaataatctgtataacaaaaccccgtgacatgagtttgcctatgtaacaaaccttcacatgtacccccgaacctaaaataaaagttaaaaaaaaattagggctattcaattctgcattaagcctcttgtcagccattg

SEQ ID NO: 406009 - DNA, 1958 bp, Homo sapiens
agctctgtgcgggattctaggctcccctgtgacagccgcggcaggaagcaggcgggcgctccccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgagaaataagaatcacggccgggcgcggtggctcacgcctgtaatcccagcactttgggaggctgaagcgggcgaatcacgaggtcaagagattgagaccatcctggccaacatggtgaaaccccgtttctactaaaaatacaaaaattagctgggcctggtagcacgtgcctgtagtcccagctacttgggaggctgaggcaggagaatcacttgaacctgggaggcggaggttgcagtaagctgagaccacgccactgcactccaacctggcaacagagtgagactccatttcaaaaaagaaaaaaaaaaaaagaaataagaatcactaactgctcttatagaaattatgatattcaagtaaaataatgaaaataaagcactttagttttcaaattattagtattttttctctgtagatagtcttcatctaattttaaaattgcaatgataatataatagtttgagtatttgtatacatgatgaatttgagtatatatgatgaatattcatgtactttttatagaatctatttattagagatcccagtaagacctatatattatagattaaccattagtgatttatgtataatgagtagaaaaagacagcaggaattaatatttttgttgttaaagattatttttaaatagtagtaatgaagtaattttaaatcaaataaactttgaaatattgtttataattttattttaataagtccaatttgaaattttaaaatcttccaggccatagcctatctagagacataactagagtaatactaagagccagaactcagctgattgtggtggcttacgcatgtaatcccaacactttgggaagccaaggcgggtggatcatttgaggtcaagagttcgagactagcctggccaatatggtaaaaccctgtctctactaaaaatataaaaattagctgggtgtggtggcacacatctgtagtcccagctactcaggaggctgaggcagaatcacttgaacccaggagatagaggttgcagtgagccaagatcatgccactgcactccagcctgggtgacagagggagactccatct

SEQ ID NO: 406010 - DNA, 2207 bp, Homo sapiens
tttttttgagacagggttggccaggctggcctctttatctgtttttgtattgttttctcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaagctccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacatttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctctcaaagcgcggcgcacgaggccgggccctcgtgccgacgcaa

SEQ ID NO: 406011 - DNA, 3123 bp, Homo sapiens
  misc_feature (535)..(535): n is a, c, g, or t
ggtctggctttgcagtcggctgagctgagctgggggaagagcgatgggggtgtgccctgggaccagcacatctgacgtaggccccacatgttcatttctgaaaatagtttctcctcaccagtgagaaaatgaggaaggaatcctcctcatgagacaggtgagtgaaccaggagagggagttccaggtgccctgcaaggttgttagcagttccctgttcccagatagttttgtcaaagatctcagaataagagaggaaaaaattatgtaaaacaaaaatgcgaagaatggggtagtgagaatgaatgaatgtaaaaccctggtctgatccataattagtcacttacatgcgaagtctggcgagctctctggccctctgcttgtggtggaccctctgcttgtggttaagctggacttatggtggacagtgtcccctttagttctaagaatcccctatcaatggtgaacctcttttttttttctttgtattttcctcaagaactgtgtgacagaatatctagatgtgtggttgatttnaattttttatttcattttatttttgagaccgagtcctgctctgttgcccaggccggagtacagtagtgctatcttggctcactgcaacctccacctcctgggttcaagcgattctcttgcctcagtctcctgagtagctgggattacaggcacataccaccatgcccgcctcatttttttgtatttttagtagagacagggtttcaccatgttggccaggcttgtccggaactcctgacctcaggtgatccacctgcctcggcctcccaaagcgctgggattacagttagagtctccatgcccggctgattttaaattttaaaattaagccttgtatagcctgggcaacatggtgagacccttccacaaaaatgaataaataaataaaattaaccaggtgtggtgatgtgtgcctgtagttccagcgactggggaggctgaggtgggaggatcccttgagcccaggaggtcaaggctgcagtaagctgtgatcatgccactgtcctccagtctgggtgacaaagcaagaccctatctcttaaaaaaaaaaaaaaaaaacccaggtgtggtggcccatggcctgttatcacagcactttgggaggccgagatgagagggttgcttgaggccaggaggttgaagctgcaatgaactgtgattgtgccagtgcactccagcctgggtgatagagcaagtactctgtctcaaaaaaaaaaaaaattaaactggttatgaaagattgctgtattgtctttttctacgtgacaagcatttgttctccatcacgaataattcagtcaaaatcaattcatttctaaacaaaaagagttaagttttctgttttttagactttaccatccagcacagctgacagtccattggcattactttaaagtaactttttgataactgattcctaaattgctttttgaatttgtttattctattcattattgttttgaaggaaacctttgtcaaaccaatccaagcgtggtagttagtaaactatgaatttaacggcacatttcaccagtaagaccctccttctcagtatggttgaaatccagtatcattattacttgagacagggtcttgctctgtcacccaggctggagtacagtgatgcgatcacagctcactgcagcctcaacctcctgggctcaaacgatcctcccaccttggcctccccacgttttgggattacaggtgtgagccactgcatctggccagtgaaatctattatttatcagatctatcttcatgaaaattttgtcttatttaaaataacattccaaccccttttctctcctttaattaacagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcaggtgagtaaatgagctgtgcttgcagagttggaagaaagcaggtggttcttgtgctgtttgggtgctttcttattccaagcttttcaaaggaggtctcaggctgatgctgtgtcacccttgcagcagccccacgaaggggttaccggtgttgccctgttttataggggttatcactgttggtcaccatccggaaaggctgtgcaatggaaaatactgttccatggttcaaataagaaaaatctctttaggaaaacataggttgaattcagcactatcatcatccatgaaagctaactaaaaagcaaaaatctcatatcatatgcacaaaatctctgactttgaaatgcttcatgttttaaatcgaagtttctggagtgaggctgatggcgctaagttcctttcagtgggtgcctcagtgtctgtgctttgccgtgtgctagggttgcagaggcaatgggaaggccagtccctcccctggggtttgcgcagagtaaactgtgtcttggggtttccagtcggttattttgttccacttccacggaacttggggatgaggacagagcagcccctgtagcacctgctgttctaggccctgcatgattccgttcagtgcaatgtgaccaggaccgcggcccaccgcacagagcgccacctcacctcgcacacactctgctgcccattctggcagcggctccaaggaggctgccaggattccttgccacaagcccgtagtggccacagcgtggggaggatgctgcctgggagatcctgggacctgccttggttgatctgtggctccaggtcatttctttggtcacacatcagggcctcctgtaaacagtgactaaacccacagtcatgtcacagtcagaaggtcttttgcaggtttgctccttgtcagatctgcaggttgccaaacagaactgatattctggagtaaatgaaaaggttttccacaacttgccacttgtagttaatattggctgggtgctttggctcacacctgttatcctggcaccttggcaaacttgggaggtgggaaaattgcttgagctcaggagttcaaggccagcctgggcaacatagggaggccctgtctctact

SEQ ID NO: 406012 - DNA, 413 bp, Homo sapiens
aaaaataaatgactactcagatgaggtttctaacatgatccagatctagtaccttcccagagataggtcgtggtttattgacatcccaaaactgttcagtttcttttttattcaaatagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406013 - DNA, 362 bp, Homo sapiens
gtgggctagtagttacagatgttttcatcacaggttcaatagtgtgagaaagagacactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406014 - DNA, 907 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtgcatcgataacacggtaccgactcgatctaca

SEQ ID NO: 406015 - DNA, 693 bp, Homo sapiens
tgagacggagtctcgctctgtcgtccaggctggagtgcagtggcgcgatctctgctcactgcaagctctgcctcccggcttcacgtcattctcctgcttcagcctcccgagtagctgggaccacaggcgcccgccaccacaccaggctaatttttttgtatttttagtagagacagggtttcaccatgttagccaggatcgtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtgagtcctgtgttcctacaggcaaaatccacacacacggggaagagtcttttaacaaattcaaaatatatgagctattagtttctgtattcagtggtaaaaggatgagggaaaatgttatagcaatgaatacctaaaatagactaattggattatactgcatttcagaaatact

SEQ ID NO: 406016 - DNA, 556 bp, Homo sapiens
atgtggtatttgtggacctaggtctgtgtgatatttttctttcttcttttcctgaaagtctttataattcaaatatagaattagattcttcaagtgttttttttgttttttgttttttttaaatctgtagaattctagcaaattggttaaaagtcaagttcatgggagatgaaggctcagtggatgacacatccagcgatgctggtgggattcagacgctttcgcttttcaactcacttagcagcaaaggggatcagatgattttttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctcattcttccttcagtggttaaagatgcaaaaacagagtttcaatcacagatatgtgccactgaacaggtaaaaactgtgctcctggactggctttaggaagtccttcaa

SEQ ID NO: 406017 - DNA, 6538 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggcttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406018 - DNA, 2862 bp, Homo sapiens
tgagacggagtctcgctctgtcgtccaggctggagtgcagtggcgcgatctctgctcactgcaagctctgcctcccggcttcacgtcattctcctgcttcagcctcccgagtagctgggaccacaggcgcccgccaccacaccaggctaatttttttgtatttttagtagagacagggtttcaccatgttagccaggatcgtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406019 - DNA, 7487 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacgggtaagagctgagaatggaactgtggggcccctgtctccttttttcttgttaattctgatgaagggctgtgaagggctggctgcttgcctgacttgaagaaggtgcattccctctgccatgcaggtgaacacacgagactcagaatggctgggggtgttcccaaggtcacatcctggctgtcagcacattgagggctcagaccaagttctttgtgactccaaaatcagtccttttcatgacttgctgacaaacctaaagataaaagttagggccttctttattctttcccttgactgcctttgccagccaatgacggacaacctctgacggctgggatggaggcacccgcaggccagccggagtcttctccggtacttaccagtcagagtggtgagactcacagacgctctctcagaaactggcagcttacactcaacacccggtgcctagttccccaccctgtctcctctaactcctcacctgcctcctgcctgtctcctccttccagttctgtctccttctagttctgtctcctccttccagttctgtcctcagaaaattagacggttttgggtgagccagcaaggaggcaggagtgagtcagcgtgcgtctgttaacacgctgggcttagtggttctagggacctacagaggctccagggtgggcggcagtgggacctggcgcctgtgctttctgtcatttacacatggctgtggtgacacccaaggggcttgcagtactcggcagggcactgagggcgaagctgtcttctcccctggtgacacccctcgggggtcttttgtggtctgggtagctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406020 - DNA, 3894 bp, Homo sapiens
aaggctcttgttagaatgccgtgaacagttgtctccaactattatatgtcattccacgggattggtttcctgctggcattccatggtctccggggtcctctgcagcaccttcctggccttttgtcatgtggatgctgcacagctgacttcacctggtcttgttgatggacagtttgtttcatgatttctcttatgaataaaaccttcacaagccatccttctctatgagagtgtttgcttggcacgcattcctgagcactgcccctgagcagaccgcctatgatctctaagcttgggttccgtgttgccaaagcgccttctggtggactcagcccaggaggagcccatgtgccccacgctggccatggctgtggtcatgggctgactgcatgtgtctgactgggccttcgtctgagactgcagtgatttcgctcctcctctcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406021 - DNA, 3318 bp, Homo sapiens
acgaatattataggtccggtccctggtttaatttcgtacggggctggtcttggtatccagataggagttactcctaaggactcacagaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406022 - DNA, 3313 bp, Homo sapiens
aagagatgtagcaggcgttccccgttttatttcagttcatcgggctggtgcttgttgtaaataacatagtgcccgctagcctgacaataacatgtatactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406023 - DNA, 7781 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggtaaggtttcatcatttttaatggtctgtcaagatattttgttttttccccttttgctgtatcttgaattgagtgtatattagcgtttgcattgtctttttcttaagagacagggttttattgtcacccagtatagtggcatgatgatagctccctgcaacctcaaactacagggctcatgcaatcttcccacttcagtctcccaagtatatgggactactgtggtgtgccactgcgcctggcagcagttgtatgttttatacagataactttctaaaaacataagcagaaatcaaaataaaagataaaatttgcccacagtcctgctatctgcaaattaaattgttcatgtaaaattttttagtgtttttgtttctatgaatttaaaatatgaacatgtcttatatctgaaggtcagatacagaagttatttttctagggtaattgtcctctgaatatatgaagaaataatgttatttgatgtttcctttaaaaaggaagtctgaagctgggcgtggtggctcctcgcacctgtagtctctgctactcggaggctgaagcaggaggactgcttgagctcaggagtttgagaccagcctggccaacatagcaagacccccttctcaaaaacaaaaaaaatagggcagggggagtctttgctaacaatttagagaaagaggtgccaggaattaaaataactataggaagtaagataaccatagggtgtgaaggcaccttggcacatagtgaagctgttagtccttccaaaaaggagaagactccatttctgtgcatggtgaaggggatgttcagggctggtttcctgagggcctgggcctttccatggggcaaccatgcaggtcacactcctcctcaggccaggtgggatctgggggctctctttagtgcccctactggacatgtctccagagccctagaaggctaaactcaactgcataggacacttctgttccccttcctaccacagttgagagcccagtactctggtattacctgctgtgggcaaccttgggggatcaagccctttcagaaagctgtttttgaaaaacagtgtgaattgttcaaccaagtctcttctttcttctcaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406024 - DNA, 3029 bp, Homo sapiens
  misc_feature (2870)..(2870): n is a, c, g, or t
tgagacggagtctcgctctgtcgtccaggctggagtgcagtggcgcgatctctgctcactgcaagctctgcctcccggcttcacgtcattctcctgcttcagcctcccgagtagctgggaccacaggcgcccgccaccacaccaggctaatttttttgtatttttagtagagacagggtttcaccatgttagccaggatcgtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtcaaacaaaanaaaaaaaaacattgcggggcgcgccccaagatttcaaaaatcgtgggcggccagataaaatgcaagtcaaactcggcaacgggttccaaaaacgcggcggtgaaccagtctggtagtcaacgcacacaccagcgcgcggagacgaccaaaagatatacc

SEQ ID NO: 406025 - DNA, 1652 bp, Homo sapiens
gccggaccgacaacggcaccacgtggcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406026 - DNA, 8133 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaagctccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacatttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctcttcgcactcgctgtcgctcgctcgagcctcgctccccacgtccttccttccgacccgcggctggaccctcctcacaaatttctcagagaggctcacctcaaagcgcggcgcacgaggccgggccctcgtgccgacgcaa

SEQ ID NO: 406027 - DNA, 1042 bp, Homo sapiens
attctagaggatacccagtccgttcgactgagcccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406028 - DNA, 2633 bp, Homo sapiens
tttttttgagacagggttggccaggctggcctctttatctgtttttgtattgttttctcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaagctccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacatttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406029 - DNA, 2592 bp, Homo sapiens
aaaggtttttttcaaaaaacagctcaataaaaaaaaggtcacaaaaagagggattttttttaaaaacgatttgaaaaaatatgatgttcctttgtcgtgggaacaagccaggttgcagacgcagaaggagctacagctgagagagggacgacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaagctccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacatttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406030 - DNA, 5545 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctgtgcagtctccctcagtctctaccagcccctgctgccctcctcagtgcctctgg

SEQ ID NO: 406031 - DNA, 5343 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtgaactataattactttgtgtttacttctgtgttttcattactttcacttactcccagatatcactggaaccatgcaaatactgcttattccctaatgtggttttgaaagactgggaggctcagaagcaagtattatgtctgtccgtacatgtcgtttaaaaaattatttttttaagccagtcaaattgagtagtgggcaccaagcccagcctgcttctttactttttctgttttaatactatatattggatttcctaaatgtaatatgtacacaaaacttttaaaaaatgaggaaatgtaaaagaagtataaagatgatgataagagccatccatgctcttgccattctgaggtaacagtaacttcttggtgcaaattcttcccttttcctgggattacaaagtcacatttcatctactggaaattagtttactgctgctgttaccttcattttcat

SEQ ID NO: 406032 - DNA, 5251 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtttgtgaaggaagtctcgtttatgaagcagcattgtttaataaatgggtggaggccctgggtctgaggatggtccagtagtcttcgggtcgtttggaatcactgaga

SEQ ID NO: 406033 - DNA, 4913 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggtcagcatcagctgtcgcctgcctcgtcagggctcccctgcccccacttggttttaccaggagcggaattaatgtgtgtgtttggagggtgaagataggtgaagcctggaggcgaagataggtgaagcctggaggcgaggacaggcacagggttgcattttgaaggttgtctcccacagttgtggacatgtgacttgttccactggcaaagcagagctctgagttcaccttgaaagactcagcgtcctggtgcctgagtctgactctgcatcacgtgttcttttcctgctcgtcccagtttaagtacctgccacttccatccttgttggaggagccggaggtccacgctggcctgtgtcttccgatcccatccccgccccatccctc

SEQ ID NO: 406034 - DNA, 4303 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagtaagtgaaacgctggtgtcttgctgtgccaggagagtgagctttggctctgccctaggctgtgtcttgcaccactgaggatgggctattggaaatggatcttgcctgtctaagctactttgattttg

SEQ ID NO: 406035 - DNA, 2223 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgtgagtactcccatcttgccatttgttaccctagatttgaaccttgtcactttaaaacctgttttttttttttggtccctcagttgtttgcttactataatatagagaaagtactcaaatatcttattagcataggtgggattacaggcgtgagccactgcgcccagcctaaatgtatgcataata

SEQ ID NO: 406036 - DNA, 420 bp, Homo sapiens
gaaacgctaaggttttgacagcgttacagtgaattctccggctgtagagattggaggaagtcgggagaaattcgtctctaagttgtaaggtggaacagcattcattttcttactgccaatggaggtttttcatgaatttactaactcagtaaaaagattcggcttttttttttttaatcttaaaggatcacgctttaaacctctgtaacaaagtaattatttgtaccactctctaccccaccctccaacaaaataacctatcggctctcagaaaataataaccctttgcctgcctttgaaatagttatccttttagtatgacagtgttcaaaaattcttttcttagacttgtagcagaacatagctatgatgatctgaatttttctctttcagcttgttctaaagacgaaggggaactcc

SEQ ID NO: 406037 - DNA, 362 bp, Homo sapiens
atgacagcagcttctgttggagcacatattgtctgagctttggcattacccagacctctcttctgggattaatttttcctgaggaaaactaatgaatgaggaaggtaagctcccagaagtcaagagcctcacccaagagtgttcaagtagtgagtggtcaggttgcttttcaaagccagatccaactggctccaaagcctaaggtctttttaccttaccattcttccttcagtggttaaagatgcaaaaacagagtttcaatcacagatatgtgccactgaacaggtaaaaactgtgctcctggactggctttaggaagtccttcaatagaggagaaaagcaaattaaaatgatgtactgtt

SEQ ID NO: 406038 - DNA, 399 bp, Homo sapiens
tcgactattactactaatttcgcgggcggcgtcgaccagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406039 - DNA, 6672 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406040 - DNA, 7230 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggtattggctgcctccaacctggatgctaaaaaatccacgcaaattccaaagtcaaactgatatttttattactctgttatatattttatctgtaacaaaaatgtacttttgtgggccaggtgcagtggctcaggcctgtaatcccagcactctgggaggccgaggtgggtggatcacctgaggtcaggagtttgagaccagcctggccaacatggttaaaccccatctctactgaaaatacaaaaattagcttggcgtggtggcacacgcctgtagtcccagctactcgagcggctgaagcagaattgcttgaacctgggaggcggaggttgtggtgagccaagatgacaccactgcactccagcctggcttctgtctcaaaaaaaaaaacaaaccccaggacttttatttaagtcactacaaagtcctattaaaatgtgcatcatgggctttgtttcaaattgaaaagtgagaaattgaggtcgtagcatgatccttctcacggttgcctctttgcatgggaatgtgtgtgtgatcctccccctcgcctgtggccaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406041 - DNA, 5469 bp, Homo sapiens
  misc_feature (535)..(535): n is a, c, g, or t
ggtctggctttgcagtcggctgagctgagctgggggaagagcgatgggggtgtgccctgggaccagcacatctgacgtaggccccacatgttcatttctgaaaatagtttctcctcaccagtgagaaaatgaggaaggaatcctcctcatgagacaggtgagtgaaccaggagagggagttccaggtgccctgcaaggttgttagcagttccctgttcccagatagttttgtcaaagatctcagaataagagaggaaaaaattatgtaaaacaaaaatgcgaagaatggggtagtgagaatgaatgaatgtaaaaccctggtctgatccataattagtcacttacatgcgaagtctggcgagctctctggccctctgcttgtggtggaccctctgcttgtggttaagctggacttatggtggacagtgtcccctttagttctaagaatcccctatcaatggtgaacctcttttttttttctttgtattttcctcaagaactgtgtgacagaatatctagatgtgtggttgatttnaattttttatttcattttatttttgagaccgagtcctgctctgttgcccaggccggagtacagtagtgctatcttggctcactgcaacctccacctcctgggttcaagcgattctcttgcctcagtctcctgagtagctgggattacaggcacataccaccatgcccgcctcatttttttgtatttttagtagagacagggtttcaccatgttggccaggcttgtccggaactcctgacctcaggtgatccacctgcctcggcctcccaaagcgctgggattacagttagagtctccatgcccggctgattttaaattttaaaattaagccttgtatagcctgggcaacatggtgagacccttccacaaaaatgaataaataaataaaattaaccaggtgtggtgatgtgtgcctgtagttccagcgactggggaggctgaggtgggaggatcccttgagcccaggaggtcaaggctgcagtaagctgtgatcatgccactgtcctccagtctgggtgacaaagcaagaccctatctcttaaaaaaaaaaaaaaaaaacccaggtgtggtggcccatggcctgttatcacagcactttgggaggccgagatgagagggttgcttgaggccaggaggttgaagctgcaatgaactgtgattgtgccagtgcactccagcctgggtgatagagcaagtactctgtctcaaaaaaaaaaaaaattaaactggttatgaaagattgctgtattgtctttttctacgtgacaagcatttgttctccatcacgaataattcagtcaaaatcaattcatttctaaacaaaaagagttaagttttctgttttttagactttaccatccagcacagctgacagtccattggcattactttaaagtaactttttgataactgattcctaaattgctttttgaatttgtttattctattcattattgttttgaaggaaacctttgtcaaaccaatccaagcgtggtagttagtaaactatgaatttaacggcacatttcaccagtaagaccctccttctcagtatggttgaaatccagtatcattattacttgagacagggtcttgctctgtcacccaggctggagtacagtgatgcgatcacagctcactgcagcctcaacctcctgggctcaaacgatcctcccaccttggcctccccacgttttgggattacaggtgtgagccactgcatctggccagtgaaatctattatttatcagatctatcttcatgaaaattttgtcttatttaaaataacattccaaccccttttctctcctttaattaacagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406042 - DNA, 4709 bp, Homo sapiens
aaggctcttgttagaatgccgtgaacagttgtctccaactattatatgtcattccacgggattggtttcctgctggcattccatggtctccggggtcctctgcagcaccttcctggccttttgtcatgtggatgctgcacagctgacttcacctggtcttgttgatggacagtttgtttcatgatttctcttatgaataaaaccttcacaagccatccttctctatgagagtgtttgcttggcacgcattcctgagcactgcccctgagcagaccgcctatgatctctaagcttgggttccgtgttgccaaagcgccttctggtggactcagcccaggaggagcccatgtgccccacgctggccatggctgtggtcatgggctgactgcatgtgtctgactgggccttcgtctgagactgcagtgatttcgctcctcctctcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacgggtaagagctgagaatggaactgtggggcccctgtctccttttttcttgttaattctgatgaagggctgtgaagggctggctgcttgcctgacttgaagaaggtgcattccctctgccatgcaggtgaacacacgagactcagaatggctgggggtgttcccaaggtcacatcctggctgtcagcacattgagggctcagaccaagttctttgtgactccaaaatcagtccttttcatgacttgctgacaaacctaaagataaaagttagggccttctttattctttcccttgactgcctttgccagccaatgacggacaacctctgacggctgggatggaggcacccgcaggccagccggagtcttctccggtacttaccagtcagagtggtgagactcacagacgctctctcagaaactggcagcttacactcaacacccggtgcctagttccccaccctgtctcctctaactcctcacctgcctcctgcctgtctcctccttccagttctgtctccttctagttctgtctcctccttccagttctgtcctcagaaaattagacggttttgggtgagccagcaaggaggcaggagtgagtcagcgtgcgtctgttaacacgctgggcttagtggttctagggacctacagaggctccagggtgggcggcagtgggacctggcgcctgtgctttctgtcatttacacatggctgtggtgacacccaaggggcttgcagtactcggcagggcactgagggcgaagctgtcttctcccctggtgacacccctcgggggtcttttgtggtctgggtagctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406043 - DNA, 8462 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaagctccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacatttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406044 - DNA, 1882 bp, Homo sapiens
aactaggctgtcaggtccaacgctcattgtgagttgaacagatgcttaaccccacatgggtatcagatgatttctgtgtactgtgtgtataatggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406045 - DNA, 3021 bp, Homo sapiens
tgagacggagtctcgctctgtcgtccaggctggagtgcagtggcgcgatctctgctcactgcaagctctgcctcccggcttcacgtcattctcctgcttcagcctcccgagtagctgggaccacaggcgcccgccaccacaccaggctaatttttttgtatttttagtagagacagggtttcaccatgttagccaggatcgtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtcaaaaaaaaaagggggggtttaaatatcctggagggcagttaaggtacagtttggaaaggggctaagggaggtaaggaggagggggtaaaggggagggaaagaggattggggactttggggaatggaccagtgcgaaatagtatggattgggttgtaaaag

SEQ ID NO: 406046 - DNA, 8036 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaagctccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacatttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctctcaaagcgcggcgcacgaggccgggccctcgtgccgacgcaa

SEQ ID NO: 406047 - DNA, 960 bp, Homo sapiens
  misc_feature (43)..(43): n is a, c, g, or t
tccatggggagggagtcttgctcttccagctacagtaggttcngtgtgagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 406048 - DNA, 5876 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcaggtaattagagcttgatgc

SEQ ID NO: 406049 - DNA, 5156 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgattttttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctcattcttccttcagtggttaaagatgcaaaaacagagtttcaatcacagatatgtgccactgaacaggtaaaaactgtgctcctggactggctttaggaagtccttcaa

SEQ ID NO: 406050 - DNA, 4503 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtgagtcctgtgttcctacaggcaaaatccacacacacggggaagagtcttttaacaaattcaaaatatatgagctattagtttctgtattcagtggtaaaaggatgagggaaaatgttatagcaatgaatacctaaaatagactaattggattatactgcatttcagaaatact

SEQ ID NO: 406051 - DNA, 4326 bp, Homo sapiens
ggcagcgcgggcctcggggtcctggggcgagacggtgagcgtgggggctgggccggcgccaggggcgccgtttccttcccccacgcagctccgcgcgcccgggcctccacatcgtcgctaacggagcgttgcggcgccggcgacccctggcgagcccggggcgggacagtggccaggccggcctgggcccagcgcgtggcctccgccgtttcgggctgtgctgggtggaagattaggctccccgggcacgccgtccccgccgagaggcctcagcttcgtggcagcgccctcgtccttccagcccgctcgagggtggccgccagggcgcgatgaaggaatgtgagaaagtgcttagcgctccagccgctccgagggaagccaggtgggaggagatcccgaaacgctaaggttttgacagcgttacagtgaattctccggctgtagagattggaggaagtcgggagaaattcgtctctaagttgtaagcttgttctaaagacgaaggggaactccctagtgctacaggctgtttcaggaagccaattaattttgtacacgtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaatatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcaggtgagtaaatgagctgtgcttgcagagttggaagaaagcaggtggttcttgtgctgtttgggtgctttcttattccaagcttttcaaaggaggtctcaggctgatgctgtgtcacccttgcagcagccccacgaaggggttaccggtgttgccctgttttataggggttatcactgttggtcaccatccggaaaggctgtgcaatggaaaatactgttccatggttcaaataagaaaaatctctttaggaaaacataggttgaattcagcactatcatcatccatgaaagctaactaaaaagcaaaaatctcatatcatatgcacaaaatctctgactttgaaatgcttcatgttttaaatcgaagtttctggagtgaggctgatggcgctaagttcctttcagtgggtgcctcagtgtctgtgctttgccgtgtgctagggttgcagaggcaatgggaaggccagtccctcccctggggtttgcgcagagtaaactgtgtcttggggtttccagtcggttattttgttccacttccacggaacttggggatgaggacagagcagcccctgtagcacctgctgttctaggccctgcatgattccgttcagtgcaatgtgaccaggaccgcggcccaccgcacagagcgccacctcacctcgcacacactctgctgcccattctggcagcggctccaaggaggctgccaggattccttgccacaagcccgtagtggccacagcgtggggaggatgctgcctgggagatcctgggacctgccttggttgatctgtggctccaggtcatttctttggtcacacatcagggcctcctgtaaacagtgactaaacccacagtcatgtcacagtcagaaggtcttttgcaggtttgctccttgtcagatctgcaggttgccaaacagaactgatattctggagtaaatgaaaaggttttccacaacttgccacttgtagttaatattggctgggtgctttggctcacacctgttatcctggcaccttggcaaacttgggaggtgggaaaattgcttgagctcaggagttcaaggccagcctgggcaacatagggaggccctgtctctact

SEQ ID NO: 406052 - DNA, 2500 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgacctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406053 - DNA, 1255 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagtttatttcacagagcagtgtacattcttgtcttccaggggaacttcaacatggagttacttttgatccctcagttttaattcagtgtctaaagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggctgagcgcaccttcgagatgagaccttcacttcaggtggtaatgcgcctggtggattgtgcggtgacggtggagatttctcctgtactgccactgcgaagatgggacacttaacaaaagggaatgtgagggaaatactgatggcccaagtgtaaatgtctatgtggaactttttgagcacccatgtttacctgccgtgaattagattttttaatttgttgtatctgtttgaaatatatctattaaagaaaatctgccactg

SEQ ID NO: 406054 - DNA, 998 bp, Homo sapiens
ttttaatgtgagcagggatagtagagatgatgaatgtaggtaaggagaggaaatgagaatgaggactttcaggggcaagagatggtggtgtcattttgtgttgtgttcctgagtcaggtaccaacagatttcctctgagtagaatataaatgctaacaaattaaactgtatgttgtatacattcagcccttggtaacaaggaaaatgatagaattgaaatgttcttgtacctcactagaagcagagaaagggtgctggatatttctgtttccgataatgctgcatagatagtgccacttaaatgtagagcaaaattacagtctcctctaagtaattcctccagttaccatgtgtcctagattccgatacctgtccaatacaatttctagaactttttcacctccccatcatgtctgccttctagtgccccaaaattatgtgagatgctagaagttgtttgacctgtgattgttcttgcttccttggtccttacgtacgagtacatagcatgattgggccagaatccgtcttttgagctcttctagtaaagtaagttttgagataatacctaagaccacatggaaatttggttggtctaagtagaggacaagcacgtatttaactacctttggcaggggaaaaagtgaagtgggagagcttaccagtgctacctatgtgtaggctgacactctgaaacttcagtctccaggaatctccatatgttggcactattttgttgattatttttctataaggttatatttctttggaagatcagtaaacttgctgttctaacccaaattcagtgtagtcttcagcttctgaataaggaataaaggaatcgaatgtgctttggatgttcttttaacaatttcagaatgttggcatgccctttgagcatctaaacttccctcagcgaattggtatttatttatttatttagagatagaatcttgccttcactccagcctaggcaacaagagtgaaactccgtttca

SEQ ID NO: 406055 - DNA, 934 bp, Homo sapiens
ttttaatgtgagcagggatagtagagatgatgaatgtaggtaaggagaggaaatgagaatgaggactttcaggggcaagagatggtggtgtcattttgtgttgtgttcctgagtcaggtaccaacagatttcctctgagtagaatataaatgctaacaaattaaactgtatgttgtatacattcagcccttggtaacaaggaaaatgatagaattgaaatgttcttgtacctcactagaagcagagaaagggtgctggatatttctgtttccgataatgctgcatagatagtgccacttaaatgtagagcaaaattacagtctcctctaagtaattcctccagttaccatgtgtcctagattccgatacctgtccaatacaatttctagaactttttcacctccccatcatgtctgccttctagtgccccaaaattatgtgagatgctagaagttgtttgacctgtgattgttcttgcttccttggtccttacgtacgagtacatagcatgattgggccagaatccgtcttttgagctcttctagtaaagtaagttttgagataatacctaagaccacatggaaatttggttggtctaagtagaggacaagcacgtatttaactacctttggcaggggaaaaagtgaagtgggagagcttaccagtgctacctatgtgtaggctgacactctgaaacttcagtctccaggaatctccatatgttggcactattttgttgattatttttctataaggttatatttctttggaagatcagtaaacttgctgttctaacccaaattcagtgtagtcttcagcttctgaataaggaataaaggaatcgaatgtgctttggatgttcttttaacaatttcagaatgttggcatgccctttgagcatctaaacttccctcgggatcctctagatcacccc

SEQ ID NO: 406056 - DNA, 672 bp, Homo sapiens
ttttaatgtgagcagggatagtagagatgatgaatgtaggtaaggagaggaaatgagaatgaggactttcaggggcaagagatggtggtgtcattttgtgttgtgttcctgagtcaggtaccaacagatttcctctgagtagaatataaatgctaacaaattaaactgtatgttgtatacattcagcccttggtaacaaggaaaatgatagaattgaaatgttcttgtacctcactagaagcagagaaagggtgctggatatttctgtttccgataatgctgcatagatagtgccacttaaatgtagagcaaaattacagtctcctctaagtaattcctccagttaccatgtgtcctagattccgatacctgtccaatacaatttctagaactttttcacctccccatcatgtctgccttctagtgccccaaaattatgtgagatgctagaagttgtttgacctgtgattgttcttgcttccttggtccttacgtacgagtacatagcatgattgggccagaatccgtcttttgagctcttctagtaaagtaagttttgagataatacctaagaccacatggaaatttggttggtctaagtagaggacaagcacgtatttaactacctttggcagggtgtccgactgaccgaatcctgggagtgaccgcgca

SEQ ID NO: 406057 - DNA, 840 bp, Homo sapiens
gtagctgagatctgtttttattttacctgtcccttttgctccttccatttccatcactacctttagactcatttgcctgcatatccattttcaaaagatcctgcttaggccaggagcagtggctcacaccttcatcccagcactttgagaggccaaggcaggaggatcacttgagctcaggagtttgagaccagcctgggcaacatggtgagatctcatctctacaaaaaatacaaaaattagccaggcatggtagcacatgcctgtatacctagctacttgggaggctgaggctaaggaggatcccttagcccaggagttccagggtgtggtgaactatgattgtgccactgcactccagctggggcaacagggagatactctgtctctttaaaaaacagtggttactagatggaaagataaattctagtgttaccttgcactgtagggtgactaacagtaattttttattttttttgtatggctaattcagtacaaatggaaagtgtttgaggtgatgcatatgcaattatgctggttttttttaatccctatacattgtattggaatttacaatgtaccccataataaaggatagaggaatatttacagtatcatctatttggttaaatgttattcagcagttctggcctgctgcctttttttgtataacctatggcccaagaatggtttctacattttttaatagttgagcaaaaatcaatagaataatattttctaatacataaaattagatgaaatttcagtttcagtgttcataaataaagctttatgagagccatgctcaattgccttgaggctgctttcagcctacaacaa

SEQ ID NO: 406058 - DNA, 329 bp, Homo sapiens
acatagtggtatatatcttaaagcagaaaaccccaaaaaacaaaaacaaggaaaaaagaaaatacatgtcaacagtcagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406059 - DNA, 1005 bp, Homo sapiens
ggcctacacaaagttttttaacccaccaatccctttaacgtttttgtttagaatagtctgtgcaacaaacagttttgatagaagtcttggaacagcgcagtccaatattttctgattttggcttattcaattgtagggaaacaaatatttaaatctgtatagtgttagtcgtctttttgcatttttctatttctatctaccgtctttttcataaggacaagggaatatgttatcttaaatgtcctttaaaatttgcatggcattgggaaagagtgacttaatctgttaaaaaactggtaacaatgccatttgtcaccattatagaatttcgattattcatgtaatattgaatagtgtactgacatgtctgcgtgttttcattacccctcttgttttcgaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagtaagtgtctttcgtttattctttccagctaaagatgtagttgaggatgttttgtttaaaggcagtacataagcaggcaaaagtcctaaaactttgttttcaaaattagtaatgtaattttgccttttagaacagttggtgttagtgaggaaaattgtgtggattaaattgatctctagaggagggggtttaatttcacagcagcctcaatattcttgtcgagagagtgtatttgaactgaaagaacagttaactaattagatttggaacttggcatcattactttgccaccattactttgccactaactagttgtgtcactgtggtctttaaacttttctttgcctaattttgatttc

SEQ ID NO: 406060 - DNA, 281 bp, Homo sapiens
  misc_feature (238)..(238): n is a, c, g, or t
  misc_feature (245)..(245): n is a, c, g, or t
  misc_feature (247)..(247): n is a, c, g, or t
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtacggganggcgaananaagaatagagaagatagggaaattagaagataaa

SEQ ID NO: 406061 - DNA, 647 bp, Homo sapiens
cagatattttctatgcttatctatagaaataatcagtttgtaaacttatgttctccttgaagagttttcgaattttcatgtggcaacttattcttctgttcacattcttgacagaatagaccctcccaggttcaagcgattctcctgcctcagcctcccaagtagcagggactataggcatgtgccaccaccacactccgctaattttttgtatttttagtagagccagggtttcatcatgtaagccaagctggtctcaaagctcctgacctcaggtgatccacccgctttggcctcccaaagtgctgggattacaggcgtgagccaccgtgcccagcatggtatttatgattctaagtgccatttcaaaaatctgtttgctcttttttattctctggtccactaaagagtaatctttactgtgggctttatttcatatttttatttgtcctaatactaagtggtagcttctcatttctctgtttcttgattttggagagcaagtctatgcttatctatagaaataatcagtttgtaaacttatgttctccttgaagagtttttgaattttcatgtggcaacttatttttctgttcacattcttgacagaatagaccctcccaggtcatctgcacttctgatatctt

SEQ ID NO: 406062 - DNA, 3056 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406063 - DNA, 3199 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacaggggagtggacagtttcctgttagctgcaacaacaatccaatggttgaagacaccaaacagcaggagagtggttctgttggaccaaaagaaatagaaatatatactgtgtcagcaatgcagaccccctgtcgttgcaggaatcaatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406064 - DNA, 2996 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406065 - DNA, 3002 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgattactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406066 - DNA, 4462 bp, Homo sapiens
gcatttagaatatctaaaatgatttgtccatttagctattgcttttttattcaggtgactacaaaaacatttttagccattctcttaacatgtatgaatatttagaagtagattttttttaagtttattatgtctttatgcaaattcttcactggggatgaaaaaaagaagagtatgtatattgtttcccaaacccacatgaaaaaaatcatttgtgttcactaaacttaaaagaaaatgtgttcatctttctggaagctacagaattgctgtggtcaccttcttcccagtagagaaattcagatcagttagtatatttaaaataataggttttctgtagtcaggggctatttgaccttagctaaagatccataacaaaactcaaatcctgctttttttaaaagtgaccttgctaccttcttttgaataggcagaagtggccaccttttattcctcagacattagttatttgttaaactttatccaagctggaacatacttttgaaaaacccagcccatcccgtctaccagatgccgagtccatacaccctgtgtttcccatcatttgatttatgacactctgactgagtaagcaatgtgttaaatcactagagattactcgaggctttccttgtgggacatggcactccacgtccactggaagcttgagggagctgccttcacagtcctttgagaatcagaccaaaagtcaggctgctctcctttaaacacttgagtaacttcaaatttttgttctgccaaaattatttccaagaattctacatttttgaacaactgtgtacagctatctttgcattttaaatgcccctagtttgagactcgggagggtcaagtgtccccacccctggaaagggctcggataggagggtgcttgcttctaaatcctgatcttctctatggggttggctggaagagaagtaggatcttgtctgaaacctcatccccagcattgtgtttggatgttcgtgggatccgagggctggccgggcagacagaagggaagtgcgggtcttggctggcagctgggagcagaggaagggagagcgttggaggtcgtgatgtgcgtgctctgcctcagtaggtctgaggtgcccactgttgttatgcttagttttattagattctctgtaacaacatgagcttaccaaccagccttgattttgagattaaataattgaacagattaactgggcactgaagtaaaattctacctactttattctcttagtaaaaactatacacacaataaacaactgtcaaggttgccatcatatttgagttttgtcacctaggaaaacattgtttatactttgtttttgaaaaaattcatatgaatttcccctgggaataacttgttttatttcagtttttattttctattgaaacacttgttttctagtctaggattttagccaaatagaaaagctatcatttaatttgggggaaaaaaaaatctattgtcctgtgaagaatttatagcaattattaaactatgttgcttaaatataaaaaaaaggatgattaatggaatatttagataatgtttccattcactgaagaagccgtgatcctttattggcaggaagacttgcaggacatatcagaagcctctgtcagaggtttacaggaggtgagatggaggggaagccctctatgggaagagtcccatggtgtgtgacatgttagggtaatcggatgtatttaagctgcgtcctcattctaaaagttattagaactgagctcttctagatttaataacatgctttgctttggtagtgaagaacattgagataaaatctagtattaccgagttagagataattttagatcatcccttatactgttacgtgaattcctgtgaacatgaatattactgattctcaagttccagtatacagaagaataacttgtcattgcctgtcctggtgtacccagatgttccatgatggacgttttatcccataagacgtctccctcctgatagatgtccgtatatgcagattaaactaccaacattttttccagcaaaggtggtttttgaaagtaacctaatgaaaccctggctgccatggtcattttaattgctggactgagaagaagcgactctgcgttgtgctgttggcccaggcctgcatgcctgaggactgttggccgttacagttccttgctgtggtcgccggtctctctgtattctgccactgctctcatgtggcatttggcagaagtactacgtagatttctgtgctactgaaaaaaataaaaacagtggttccttttaatagccctgatttgagacttaggagagggtcaagagtccctacctgatttatgaggagagaagattttttaaaaacctcatgtgatgctgtcatacatagttcaaagagcttccttaattcacttcatttacctttttttccattttcgcttgagaactagagaagtttgtgttctgttggaaccctctgtagaacactttacactcagttctgatggaccttttcaggggcgattttttaaaaaccgctctcgaaagtagtcttaaaatgagagcactttattgatggcttttcaggactgtgttggtatttttcatgcagtgtatttgtcagcttacatttttcagttgagctacctgatgctactgacacacatatgattttcctatcttaccaggcaaatactactgttaacgttttaatagtaagtctacttatgcacattgattttactttgaaaaaagaactggtttaaaaggaaaaaaaagaaactaaaattctttaaaattgtaatggcagtgaagcattttatagtttctcctccctcattggttctgaattttggtgacaggtgtatttcttaatgcagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406067 - DNA, 3490 bp, Homo sapiens
ggcctacacaaagttttttaacccaccaatccctttaacgtttttgtttagaatagtctgtgcaacaaacagttttgatagaagtcttggaacagcgcagtccaatattttctgattttggcttattcaattgtagggaaacaaatatttaaatctgtatagtgttagtcgtctttttgcatttttctatttctatctaccgtctttttcataaggacaagggaatatgttatcttaaatgtcctttaaaatttgcatggcattgggaaagagtgacttaatctgttaaaaaactggtaacaatgccatttgtcaccattatagaatttcgattattcatgtaatattgaatagtgtactgacatgtctgcgtgttttcattacccctcttgttttcgaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406068 - DNA, 4160 bp, Homo sapiens
tgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcgatagccttatataagcaaattcagtgactcactctagaaaagtctctcttgcctagtttaggaagtaggcacagttggctataacaaagcctagaatgtgatgttagtagactattctaatgccacaaagaatactgcttcactttaattaaaagaaattttaattaaaatggaattgtcttagtttggatcataattgaccatttatgacccacctttgtttgtttaccatagagccctgtctagaaaccagattttcattaggtcaaatacaggtgatgagcatatttaatattagtgttaaattcatttgtgacttttgcccttagcaaaatgtaacctagatttacttttagctattcattttgaaattcgtggtttctttatatttgttcatttttttgcccatcagaataatatttcagttacaaaatctaccagaattatgactctgaattcatattttctgattttaggtcctctgaattctagtcatcctcacatcctacttttgcctcctcttttttttttttttttttttttctaaaaagagacagagtctccctttgtcgtccaggctaaagtacagtggcatgattatagttcactgcaacttcaaactcctgggctccagtgatcctcctgcctcagattcttgagtagccaggactataggcacataccaccatgcccaactaatttttaaaaatgttttgtagagatggggtcttgctgtgttacccaggctggtctcaaactcctgggctcaagcagtccttccaccttggcctcccagagcactgggtttacaggtgtgagccactgtgcagcctccttttatctaattgtccccacagcagacttgtctggtcttggctattttccggttgttaaggtgtttcaggatggaggaatcagttcctgagatagttattaagttctgcctgctagaaagggacagtaagtgggttgatatcattctagacttgttaagaaattgttcagaattttgattgtttttcatagcagcttgattaaaatacagattttaataatttccttactacttttataggtagtgctttcaaataaaaccagtgtttgctaaatccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406069 - DNA, 2594 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagtttatttcacagagcagtgtacattcttgtcttccaggggaacttcaacatggagttacttttgatccctcagttttaattcagtgtctaaagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406070 - DNA, 4408 bp, Homo sapiens
gcatttagaatatctaaaatgatttgtccatttagctattgcttttttattcaggtgactacaaaaacatttttagccattctcttaacatgtatgaatatttagaagtagattttttttaagtttattatgtctttatgcaaattcttcactggggatgaaaaaaagaagagtatgtatattgtttcccaaacccacatgaaaaaaatcatttgtgttcactaaacttaaaagaaaatgtgttcatctttctggaagctacagaattgctgtggtcaccttcttcccagtagagaaattcagatcagttagtatatttaaaataataggttttctgtagtcaggggctatttgaccttagctaaagatccataacaaaactcaaatcctgctttttttaaaagtgaccttgctaccttcttttgaataggcagaagtggccaccttttattcctcagacattagttatttgttaaactttatccaagctggaacatacttttgaaaaacccagcccatcccgtctaccagatgccgagtccatacaccctgtgtttcccatcatttgatttatgacactctgactgagtaagcaatgtgttaaatcactagagattactcgaggctttccttgtgggacatggcactccacgtccactggaagcttgagggagctgccttcacagtcctttgagaatcagaccaaaagtcaggctgctctcctttaaacacttgagtaacttcaaatttttgttctgccaaaattatttccaagaattctacatttttgaacaactgtgtacagctatctttgcattttaaatgcccctagtttgagactcgggagggtcaagtgtccccacccctggaaagggctcggataggagggtgcttgcttctaaatcctgatcttctctatggggttggctggaagagaagtaggatcttgtctgaaacctcatccccagcattgtgtttggatgttcgtgggatccgagggctggccgggcagacagaagggaagtgcgggtcttggctggcagctgggagcagaggaagggagagcgttggaggtcgtgatgtgcgtgctctgcctcagtaggtctgaggtgcccactgttgttatgcttagttttattagattctctgtaacaacatgagcttaccaaccagccttgattttgagattaaataattgaacagattaactgggcactgaagtaaaattctacctactttattctcttagtaaaaactatacacacaataaacaactgtcaaggttgccatcatatttgagttttgtcacctaggaaaacattgtttatactttgtttttgaaaaaattcatatgaatttcccctgggaataacttgttttatttcagtttttattttctattgaaacacttgttttctagtctaggattttagccaaatagaaaagctatcatttaatttgggggaaaaaaaaatctattgtcctgtgaagaatttatagcaattattaaactatgttgcttaaatataaaaaaaaggatgattaatggaatatttagataatgtttccattcactgaagaagccgtgatcctttattggcaggaagacttgcaggacatatcagaagcctctgtcagaggtttacaggaggtgagatggaggggaagccctctatgggaagagtcccatggtgtgtgacatgttagggtaatcggatgtatttaagctgcgtcctcattctaaaagttattagaactgagctcttctagatttaataacatgctttgctttggtagtgaagaacattgagataaaatctagtattaccgagttagagataattttagatcatcccttatactgttacgtgaattcctgtgaacatgaatattactgattctcaagttccagtatacagaagaataacttgtcattgcctgtcctggtgtacccagatgttccatgatggacgttttatcccataagacgtctccctcctgatagatgtccgtatatgcagattaaactaccaacattttttccagcaaaggtggtttttgaaagtaacctaatgaaaccctggctgccatggtcattttaattgctggactgagaagaagcgactctgcgttgtgctgttggcccaggcctgcatgcctgaggactgttggccgttacagttccttgctgtggtcgccggtctctctgtattctgccactgctctcatgtggcatttggcagaagtactacgtagatttctgtgctactgaaaaaaatagtccctacctgatttatgaggagagaagattttttaaaaacctcatgtgatgctgtcatacatagttcaaagagcttccttaattcacttcatttacctttttttccattttcgcttgagaactagagaagtttgtgttctgttggaaccctctgtagaacactttacactcagttctgatggaccttttcaggggcgattttttaaaaaccgctctcgaaagtagtcttaaaatgagagcactttattgatggcttttcaggactgtgttggtatttttcatgcagtgtatttgtcagcttacatttttcagttgagctacctgatgctactgacacacatatgattttcctatcttaccaggcaaatactactgttaacgttttaatagtaagtctacttatgcacattgattttactttgaaaaaagaactggtttaaaaggaaaaaaaagaaactaaaattctttaaaattgtaatggcagtgaagcattttatagtttctcctccctcattggttctgaattttggtgacaggtgtatttcttaatgcagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406071 - DNA, 2665 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgactacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406072 - DNA, 4402 bp, Homo sapiens
gcatttagaatatctaaaatgatttgtccatttagctattgcttttttattcaggtgactacaaaaacatttttagccattctcttaacatgtatgaatatttagaagtagattttttttaagtttattatgtctttatgcaaattcttcactggggatgaaaaaaagaagagtatgtatattgtttcccaaacccacatgaaaaaaatcatttgtgttcactaaacttaaaagaaaatgtgttcatctttctggaagctacagaattgctgtggtcaccttcttcccagtagagaaattcagatcagttagtatatttaaaataataggttttctgtagtcaggggctatttgaccttagctaaagatccataacaaaactcaaatcctgctttttttaaaagtgaccttgctaccttcttttgaataggcagaagtggccaccttttattcctcagacattagttatttgttaaactttatccaagctggaacatacttttgaaaaacccagcccatcccgtctaccagatgccgagtccatacaccctgtgtttcccatcatttgatttatgacactctgactgagtaagcaatgtgttaaatcactagagattactcgaggctttccttgtgggacatggcactccacgtccactggaagcttgagggagctgccttcacagtcctttgagaatcagaccaaaagtcaggctgctctcctttaaacacttgagtaacttcaaatttttgttctgccaaaattatttccaagaattctacatttttgaacaactgtgtacagctatctttgcattttaaatgcccctagtttgagactcgggagggtcaagtgtccccacccctggaaagggctcggataggagggtgcttgcttctaaatcctgatcttctctatggggttggctggaagagaagtaggatcttgtctgaaacctcatccccagcattgtgtttggatgttcgtgggatccgagggctggccgggcagacagaagggaagtgcgggtcttggctggcagctgggagcagaggaagggagagcgttggaggtcgtgatgtgcgtgctctgcctcagtaggtctgaggtgcccactgttgttatgcttagttttattagattctctgtaacaacatgagcttaccaaccagccttgattttgagattaaataattgaacagattaactgggcactgaagtaaaattctacctactttattctcttagtaaaaactatacacacaataaacaactgtcaaggttgccatcatatttgagttttgtcacctaggaaaacattgtttatactttgtttttgaaaaaattcatatgaatttcccctgggaataacttgttttatttcagtttttattttctattgaaacacttgttttctagtctaggattttagccaaatagaaaagctatcatttaatttgggggaaaaaaaaatctattgtcctgtgaagaatttatagcaattattaaactatgttgcttaaatataaaaaaaaggatgattaatggaatatttagataatgtttccattcactgaagaagccgtgatcctttattggcaggaagacttgcaggacatatcagaagcctctgtcagaggtttacaggaggtgagatggaggggaagccctctatgggaagagtcccatggtgtgtgacatgttagggtaatcggatgtatttaagctgcgtcctcattctaaaagttattagaactgagctcttctagatttaataacatgctttgctttggtagtgaagaacattgagataaaatctagtattaccgagttagagataattttagatcatcccttatactgttacgtgaattcctgtgaacatgaatattactgattctcaagttccagtatacagaagaataacttgtcattgcctgtcctggtgtacccagatgttccatgatggacgttttatcccataagacgtctccctcctgatagatgtccgtatatgcagattaaactaccaacattttttccagcaaaggtggtttttgaaagtaacctaatgaaaccctggctgccatggtcattttaattgctggactgagaagaagcgactctgcgttgtgctgttggcccaggcctgcatgcctgaggactgttggccgttacagttccttgctgtggtcgccggtctctctgtattctgccactgctctcatgtggcatttggcagaagtactacgtagatttctgtgctactgaaaaaaataaaaacagtggttccttttaatagccctgatttgagacttaggagagggtcaagagtccctacctgatttatgaggagagaagattttttaaaaacctcatgtgatgctgtcatacatagttcaaagagcttccttaattcacttcatttacctttttttccattttcgcttgagaactagagaagtttgtgttctgttggaaccctctgtagaacactttacactcagttctgatggaccttttcaggggcgattttttaaaaaccgctctcgaaagtagttgtatttgtcagcttacatttttcagttgagctacctgatgctactgacacacatatgattttcctatcttaccaggcaaatactactgttaacgttttaatagtaagtctacttatgcacattgattttactttgaaaaaagaactggtttaaaaggaaaaaaaagaaactaaaattctttaaaattgtaatggcagtgaagcattttatagtttctcctccctcattggttctgaattttggtgacaggtgtatttcttaatgcagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406073 - DNA, 3404 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactcaaaaaaaaaaaaaaaaagggcggccgccctttttttttttttttttctcatttaacttttttaatgggtctcaaaattctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattggtatcattaaccagtcttttactactaaacttaaatggccaattgaaacaaacagttctgagaccgttcttccaccactgattaaaaagtggggtggcaggtattagggataatattcatttagcc

SEQ ID NO: 406074 - DNA, 2546 bp, Homo sapiens
agtaaaaaatatgctggttataaaccttaggggactacccattgaatatgtggtccatcgttgacctaaacatcattatgtcctgatagatgtccgtatatgcagattaaactaccaacattttttccagcaaaggtggtttttgaaagtaacctaatgaaaccctggctgccatggtcattttaattgctggactgagaagaagcgactctgcgttgtgctgttggcccaggcctgcatgcctgaggactgttggccgttacagttccttgctgtggtcgccggtctctctgtattctgccactgctctcatgtggcatttggcagaagtactacgtagatttctgtgctactgaaaaaaataaaaacagtggttccttttaatagccctgatttgagacttaggagagggtcaagagtccctacctgatttatgaggagagaagattttttaaaaacctcatgtgatgctgtcatacatagttcaaagagcttccttaattcacttcatttacctttttttccattttcgcttgagaactagagaagtttgtgttctgttggaaccctctgtagaacactttacactcagttctgatggaccttttcaggggcgattttttaaaaaccgctctcgaaagtagtcttaaaatgagagcactttattgatggcttttcaggactgtgttggtatttttcatgcagtgtatttgtcagcttacatttttcagttgagctacctgatgctactgacacacatatgattttcctatcttaccaggcaaatactactgttaacgttttaatagtaagtctacttatgcacattgattttactttgaaaaaagaactggtttaaaaggaaaaaaaagaaactaaaattctttaaaattgtaatggcagtgaagcattttatagtttctcctccctcattggttctgaattttggtgacaggtgtatttcttaatgcagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406075 - DNA, 2129 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtttatttcacagagcagtgtacattcttgtcttccaggggaacttcaacatggagttacttttgatccctcagttttaattcagtgtctaaagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406076 - DNA, 1717 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggctgagcgcaccttcgagatgagaccttcacttcaggtggtaatgcgcctggtggattgtgcggtgacggtggagatttctcctgtactgccactgcgaagatgggacacttaacaaaagggaatgtgagggaaatactgatggcccaagtgtaaatgtctatgtggaactttttgagcacccatgtttacctgccgtgaattagattttttaatttgttgtatctgtttgaaatatatctattaaagaaaatctgccactg

SEQ ID NO: 406077 - DNA, 2091 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggggaacttcaacatggagttacttttgatccctcagttttaattcagtgtctaaagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406078 - DNA, 6092 bp, Homo sapiens
tgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcgatagccttatataagcaaattcagtgactcactctagaaaagtctctcttgcctagtttaggaagtaggcacagttggctataacaaagcctagaatgtgatgttagtagactattctaatgccacaaagaatactgcttcactttaattaaaagaaattttaattaaaatggaattgtcttagtttggatcataattgaccatttatgacccacctttgtttgtttaccatagagccctgtctagaaaccagattttcattaggtcaaatacaggtgatgagcatatttaatattagtgttaaattcatttgtgacttttgcccttagcaaaatgtaacctagatttacttttagctattcattttgaaattcgtggtttctttatatttgttcatttttttgcccatcagaataatatttcagttacaaaatctaccagaattatgactctgaattcatattttctgattttaggtcctctgaattctagtcatcctcacatcctacttttgcctcctcttttttttttttttttttttttctaaaaagagacagagtctccctttgtcgtccaggctaaagtacagtggcatgattatagttcactgcaacttcaaactcctgggctccagtgatcctcctgcctcagattcttgagtagccaggactataggcacataccaccatgcccaactaatttttaaaaatgttttgtagagatggggtcttgctgtgttacccaggctggtctcaaactcctgggctcaagcagtccttccaccttggcctcccagagcactgggtttacaggtgtgagccactgtgcagcctccttttatctaattgtccccacagcagacttgtctggtcttggctattttccggttgttaaggtgtttcaggatggaggaatcagttcctgagatagttattaagttctgcctgctagaaagggacagtaagtgggttgatatcattctagacttgttaagaaattgttcagaattttgattgtttttcatagcagcttgattaaaatacagattttaataatttccttactacttttataggtagtgctttcaaataaaaccagtgtttgctaaatccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactataagtggaaactggtgggaccctggctggcttcagagtggagcctaatttttaaagttctttaggggagaattcttagatataaattttagtgaaagttctttgggggagaattcttagatataaatttgagtgtttgaagagacggggtcttcctgtgttgcctaggctggtctcaaacttctggcctcaggtgatcctcctgcttctgcctcccaaagcgccaggattatagggttgagccactgtgcttggcttagaggtaataaattttaatattctattcagaataagaaaatatagcatataagcatttgtatctttagtaaagttactgccagtttgatttttttttttgcaagttacttagcagaacatgtaattcacagtaaagatgattctgtgttgtaccatattttaatattcctgttttgaaagaatagtagagagaaaatgggtggcctgctcagtgattgcttttcgtagtcttggtgaatgttacaggagattgaatttatagataaaagcacagtcatcatagtttccacagtacattgcagcacatttagcttgctagcctaaaaatctgatcatgctgagtttcttttaaagaaagttaattttagaacttcaaactagaaccagtttgaacctcaagttgaccgttgtctgagttttaaaaatctcttcccattttcaaagatttttcaaatggatgtaggagaggaccaaggaggtaggctatagctgtagaacaacacagtcctattttcagaaacgaacagacacacgttttaggtcaggcacagcccatgtatccaggtgcatcaaactggggatgctaagttcaaaagtgcgtctgttttgaagatttcatctgaaaataatgtgtacactttcattactaccagtttgcattcaaaatagtttttgagactctttaaactcttctggatactttaattttccctttggaatagtgtgtaaacacagtccggatgaactttactactgatacctcacttgaggttgacaggagtggccagcagttagtgcctatggtcatgtaatacactaagtcaatacctgtggagtgaaatccggtctctataaaaaatacaaaaaaaatggctggacgcagtggctctcgcctgtaatcccagcactttgggaggctgaggtgggtgggtcatctgaggtcaggagttcaagaccagcctggccaacatggtgaaaccccgtctctactaaaaatacaaaaaattagctgggtgtggtggtgggcgcttgtaataccagctactcgggaggctgaagcaggagaatctcttgaacctgggaggcagaggttgcggtgagccgagatcacgccattgcactccagcctaggcaacaagagtgaaactccgtctcaaaaaaaaaaaaaaaaaaaaaagaaaagaaaaactagttgggtatggtgttgtgtacctgtggtcccagctactcaggaggctgaagtgggaggagcacctgagcccaggaggtagacgaggctacagtgagctgtgattgcaccactgcactccagcctgggtgatgggagtgagaccctgtttaaaacaaacagacaaaaaaacctgtggattgaagggtaaaggatggagtatttaaaaagtactgtgacagaacaaagtactgtaagtactagagttgagtgtggatggaaacacagaacctgtaaatcaagtgtttcatttacgtgctcaactcctactgaattttagcaattaaaacatgaaaactgaaatattggttaacaaatgaaaatagaatttaaagacctgaacttcttttatgatctttaatgattatttgttctaatctttgacttggaaacccaaattattttcagtctaacgtacttgaaatttaactattaaaaaagttggaggaactcaaactttgaagttagggctccctttctccagataaagcacattgcctggtttattgtaaggcacttagaacatgtaaccaaaaacactcaatttaggaataggaatgattgttttacagctaagtgcgctctcagagtcttttgttttacacccctctcaagtttacctttagatatttttcttgttgtttaatattttgtgacagatttggcaacttttaaaaagttgtttgaattgaatagtgcataaaattaatagatgtttttcagaaaatccattattaagagtagaggaatgaggagaaatattcgttctaaagagaatcaaaaccacaatgagagattgtcttacccccgttagaatgacagttaccaaaagacagtaacaaatgctgacgagaatgcagaggcaaaggaacgtttaaacactgttagtgggaatgtagacttgtacaaccgttatggagaagagtatggaggttcctgaacaaactaaaaatagaactaccatatgattcagcagtcccactactgggtatatatccaaaagaaaatccatatatggagacatctgcacctgccatgctcgttccagcactattcacagtacccaagattggaatcaacctgtgtctatcagcaaatgaacagataaaatgtggtatatataccccgtggaatactatttggccattaaaaaaacaaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttgggagtctaaggtgggaggatcacttgaggcctggagtttgagaccagcctgagcaacatctctcaaaattataaaaaaaaaaaaaaaaaagtagccaggcatggtagcacatgcctgtatacctagctacttgggaggctgaggctaaggaggatcccttagcccaggagttccagggtgtggtgaactatgattgtgccactgcactccagctggggcaacagggagatactctgtctctttaaaaaacagtggttactagatggaaagataaattctagtgttaccttgcactgtagggtgactaacagtaattttttattttttttgtatggctaattcagtacaaatggaaagtgtttgaggtgatgcatatgcaattatgctggttttttttaatccctatacattgtattggaatttacaatgtaccccataataaaggatagaggaatatttacagtatcatctatttggttaaatgttattcagcagttctggcctgctgcctttttttgtataacctatggcccaagaatggtttctacattttttaatagttgagcaaaaatcaatagaataatattttctaatacataaaattagatgaaatttcagtttcagtgttcataaataaagctttatgagagccatgctcaattgccttgaggctgctttcagcctacaacaa

SEQ ID NO: 406079 - DNA, 3061 bp, Homo sapiens
gcatttagaatatctaaaatgatttgtccatttagctattgcttttttattcaggtgactacaaaaacatttttagccattctcttaacatgtatgaatatttagaagtagattttttttaagtttattatgtctttatgcaaattcttcactggggatgaaaaaaagaagagtatgtatattgtttcccaaacccacatgaaaaaaatcatttgtgttcactaaacttaaaagaaaatgtgttcatctttctggaagctacagaattgctgtggtcaccttcttcccagtagagaaattcagatcagttagtatatttaaaataataggttttctgtagtcaggggctatttgaccttagctaaagatccataacaaaactcaaatcctgctttttttaaaagtgaccttgctaccttcttttgaataggcagaagtggccaccttttattcctcagacattagttatttgttaaactttatccaagctggaacatacttttgaaaaacccagcccatcccgtctaccagatgccgagtccatacaccctgtgtttcccatcatttgatttatgacactctgactgagtaagcaatgtgttaaatcactagagattactcgaggctttccttgtgggacatggcactccacgtccactggaagcttgagggagctgccttcacagtcctttgagaatcagaccaaaagtcaggctgctctcctttaaacacttgagtaacttcaaatttttgttctgccaaaattatttccaagaattctacatttttgaacaactgtgtacagctatctttgcattttaaatgcccctagtttgagactcgggagggtcaagtgtccccacccctggaaagggctcggataggagggtgcttgcttctaaatcctgatcttctctatggggttggctggaagagaagtaggatcttgtctgaaacctcatccccagcattgtgtttggatgttcgtgggatccgagggctggccgggcagacagaagggaagtgcgggtcttggctggcagctgggagcagaggaagggagagcgttggaggtcgtgatgtgcgtgctctgcctcagtaggtctgaggtgcccactgttgttatgcttagttttattagattctctgtaacaacatgagcttaccaaccagccttgattttgagattaaataattgaacagattaactgggcactgaagtaaaattctacctactttattctcttagtaaaaactatacacacaataaacaactgtcaaggttgccatcatatttgagttttgtcacctaggaaaacattgtttatactttgtttttgaaaaaattcatatgaatttcccctgggaataacttgttttatttcagtttttattttctattgaaacacttgttttctagtctaggattttagccaaatagaaaagctatcatttaatttgggggaaaaaaaaatctattgtcctgtgaagaatttatagcaattattaaactatgttgcttaaatataaaaaaaaggatgattaatggaatatttagataatgtttccattcactgaagaagccgtgatcctttattggcaggaagacttgcaggacatatcagaagcctctgtcagaggtttacaggaggtgagatggaggggaagccctctatgggaagagtcccatggtgtgtgacatgttagggtaatcggatgtatttaagctgcgtcctcattctaaaagttattagaactgagctcttctagatttaataacatgctttgctttggtagtgaagaacattgagataaaatctagtattaccgagttagagataattttagatcatcccttatactgttacgtgaattcctgtgaacatgaatattactgattctcaagttccagtatacagaagaataacttgtcattgcctgtcctggtgtacccagatgttccatgatggacgttttatcccataagacgtctccctccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406080 - DNA, 4503 bp, Homo sapiens
tgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcgatagccttatataagcaaattcagtgactcactctagaaaagtctctcttgcctagtttaggaagtaggcacagttggctataacaaagcctagaatgtgatgttagtagactattctaatgccacaaagaatactgcttcactttaattaaaagaaattttaattaaaatggaattgtcttagtttggatcataattgaccatttatgacccacctttgtttgtttaccatagagccctgtctagaaaccagattttcattaggtcaaatacaggtgatgagcatatttaatattagtgttaaattcatttgtgacttttgcccttagcaaaatgtaacctagatttacttttagctattcattttgaaattcgtggtttctttatatttgttcatttttttgcccatcagaataatatttcagttacaaaatctaccagaattatgactctgaattcatattttctgattttaggtcctctgaattctagtcatcctcacatcctacttttgcctcctcttttttttttttttttttttttctaaaaagagacagagtctccctttgtcgtccaggctaaagtacagtggcatgattatagttcactgcaacttcaaactcctgggctccagtgatcctcctgcctcagattcttgagtagccaggactataggcacataccaccatgcccaactaatttttaaaaatgttttgtagagatggggtcttgctgtgttacccaggctggtctcaaactcctgggctcaagcagtccttccaccttggcctcccagagcactgggtttacaggtgtgagccactgtgcagcctccttttatctaattgtccccacagcagacttgtctggtcttggctattttccggttgttaaggtgtttcaggatggaggaatcagttcctgagatagttattaagttctgcctgctagaaagggacagtaagtgggttgatatcattctagacttgttaagaaattgttcagaattttgattgtttttcatagcagcttgattaaaatacagattttaataatttccttactacttttataggtagtgctttcaaataaaaccagtgtttgctaaatccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactataagtggaaactggtgggaccctggctggcttcagagtggagcctaatttttaaagttctttaggggagaattcttagatataaattttagtgaaagttctttgggggagaattcttagatataaatttgagtgtttgaagagacggggtcttcctgtgttgcctaggctggtctcaaacttctggcctcaggtgatcctcctgcttctgcctcccaaagcgccaggattatagggttgagccactgtgcttggcttagaggtaataaattttaatattctattcagaataagaaaatatagcatataagcatttgtatctttagtaaagttactgccagtttgatttttttttttgcaagttacttagcagaacatgtaattcacagtaaagatgattctgtgttgtaccatattttaatattcctgttttgaaagaatagtagagagaaaatgggtggcctgctcagtgattgcttttcgtagtcttggtgaatgttacaggagattgaatttatagataaaagcacagtcatcatagtttccacagtacattgcagcacatttagcttgctagcctaaaaatctgatcatgctgagtttcttttaaagaaagttaattttagaacttcaaactagaaccagtttgaacctcaagttgaccgttgtctgagttttaaaaatctcttcccattttcaaagatttttcaaatggatgtaggagaggaccaaggaggtaggctatagctgtagaacaacacagtcctattttcagaaacgaacagacacacgttttaggtcaggcacagcccatgtatccaggtgcatcaaactggggatgctaagttcaaaagtgcgtctgttttgaagatttcatctgaaaataatgtgtacactttcattactaccagtttgcattcaaaatagtttttgagactctttaaactcttctggatactttaattttccctttggaatagtgtgtaaacacagtccggatgaactttactactgatacctcacttgaggttgacaggagtggccagcagttagtgcctatggtcatgtaatacactaagtcaatacctgtggagtgaaatccggtctctataaaaaatacaaaaaaaatggctggacgcagtggctctcgcctgtaatcccagcactttgggaggctgaggtgggtgggtcatctgaggtcaggagttcaagaccagcctggccaacatggtgaaaccccgtctctactaaaaatacaaaaaattagctgggtgtggtggtgggcgcttgtaataccagctactcgggaggctgaagcaggagaatctcttgaacctgggaggcagaggttgcggtgagccgagatcacgccattgcactccagcctaggcaacaagagtgaaactccgtctcaaaaaaaaaaaaaaaaaaaaaagaaaagaaaaactagttgggtatggtgttgtgtacctgtggtcccagctactcaggaggctgaagtgggaggagcacctgagcccaggaggtagacgaggctacagtgagctgtgattgcaccactgcactccagcctgggtgatgggagtgagaccctgtttaaaacaaacagacaaaaaaacctgtggattgaagggtaaaggatggagtatttaaaaagtactgtgacagaacaaagtactgtaagtactagagttgagtgtggatggaaacacagaacctgtaaatcaagtgtttcatttacgtgctcaactcctactgaattttagcaattaaaacatgaaaactgaaatattggttaacaaatgaaaatagaatttaaagacctgaacttcttttatgatctttaatgattatttgttctaatctttgacttgaatagctgttagttgaggatcctctagaaca

SEQ ID NO: 406081 - DNA, 3733 bp, Homo sapiens
tgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcgatagccttatataagcaaattcagtgactcactctagaaaagtctctcttgcctagtttaggaagtaggcacagttggctataacaaagcctagaatgtgatgttagtagactattctaatgccacaaagaatactgcttcactttaattaaaagaaattttaattaaaatggaattgtcttagtttggatcataattgaccatttatgacccacctttgtttgtttaccatagagccctgtctagaaaccagattttcattaggtcaaatacaggtgatgagcatatttaatattagtgttaaattcatttgtgacttttgcccttagcaaaatgtaacctagatttacttttagctattcattttgaaattcgtggtttctttatatttgttcatttttttgcccatcagaataatatttcagttacaaaatctaccagaattatgactctgaattcatattttctgattttaggtcctctgaattctagtcatcctcacatcctacttttgcctcctcttttttttttttttttttttttctaaaaagagacagagtctccctttgtcgtccaggctaaagtacagtggcatgattatagttcactgcaacttcaaactcctgggctccagtgatcctcctgcctcagattcttgagtagccaggactataggcacataccaccatgcccaactaatttttaaaaatgttttgtagagatggggtcttgctgtgttacccaggctggtctcaaactcctgggctcaagcagtccttccaccttggcctcccagagcactgggtttacaggtgtgagccactgtgcagcctccttttatctaattgtccccacagcagacttgtctggtcttggctattttccggttgttaaggtgtttcaggatggaggaatcagttcctgagatagttattaagttctgcctgctagaaagggacagtaagtgggttgatatcattctagacttgttaagaaattgttcagaattttgattgtttttcatagcagcttgattaaaatacagattttaataatttccttactacttttataggtagtgctttcaaataaaaccagtgtttgctaaatccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactataagtggaaactggtgggaccctggctggcttcagagtggagcctaatttttaaagttctttaggggagaattcttagatataaattttagtgaaagttctttgggggagaattcttagatataaatttgagtgtttgaagagacggggtcttcctgtgttgcctaggctggtctcaaacttctggcctcaggtgatcctcctgcttctgcctcccaaagcgccaggattatagggttgagccactgtgcttggcttagaggtaataaattttaatattctattcagaataagaaaatatagcatataagcatttgtatctttagtaaagttactgccagtttgatttttttttttgcaagttacttagcagaacatgtaattcacagtaaagatgattctgtgttgtaccatattttaatattcctgttttgaaagaatagtagagagaaaatgggtggcctgctcagtgattgcttttcgtagtcttggtgaatgttacaggagattgaatttatagataaaagcacagtcatcatagtttccacagtacattgcagcacatttagcttgctagcctaaaaatctgatcatgctgagtttcttttaaagaaagttaattttagaacttcaaactagaaccagtttgaacctcaagttgaccgttgtctgagttttaaaaatctcttcccattttcaaagatttttcaaatggatgtaggagaggaccaaggaggtaggctatagctgtagaacaacacagtcctattttcagaaacgaacagacacacgttttaggtcaggcacagcccatgtatccaggtgcatcaaactggggatgctaagttcaaaagtgcgtctgttttgaagatttcatctgaaaataatgtgtacactttcattactaccagtttgcattcaaaatagtttttgagactctttaaactcttctggatactttaattttccctttggaatagtgtgtaaacacagtccggatgaactttactactgatacctcacttgaggttgacaggagtggccagcagttagtgcctatggtcatgtaatacactaagtcaatacctgtggagtgaaatccggtcaacttgtctggagtaggggatcctctaga

SEQ ID NO: 406082 - DNA, 4058 bp, Homo sapiens
tgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcgatagccttatataagcaaattcagtgactcactctagaaaagtctctcttgcctagtttaggaagtaggcacagttggctataacaaagcctagaatgtgatgttagtagactattctaatgccacaaagaatactgcttcactttaattaaaagaaattttaattaaaatggaattgtcttagtttggatcataattgaccatttatgacccacctttgtttgtttaccatagagccctgtctagaaaccagattttcattaggtcaaatacaggtgatgagcatatttaatattagtgttaaattcatttgtgacttttgcccttagcaaaatgtaacctagatttacttttagctattcattttgaaattcgtggtttctttatatttgttcatttttttgcccatcagaataatatttcagttacaaaatctaccagaattatgactctgaattcatattttctgattttaggtcctctgaattctagtcatcctcacatcctacttttgcctcctcttttttttttttttttttttttctaaaaagagacagagtctccctttgtcgtccaggctaaagtacagtggcatgattatagttcactgcaacttcaaactcctgggctccagtgatcctcctgcctcagattcttgagtagccaggactataggcacataccaccatgcccaactaatttttaaaaatgttttgtagagatggggtcttgctgtgttacccaggctggtctcaaactcctgggctcaagcagtccttccaccttggcctcccagagcactgggtttacaggtgtgagccactgtgcagcctccttttatctaattgtccccacagcagacttgtctggtcttggctattttccggttgttaaggtgtttcaggatggaggaatcagttcctgagatagttattaagttctgcctgctagaaagggacagtaagtgggttgatatcattctagacttgttaagaaattgttcagaattttgattgtttttcatagcagcttgattaaaatacagattttaataatttccttactacttttataggtagtgctttcaaataaaaccagtgtttgctaaatccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactataagtggaaactggtgggaccctggctggcttcagagtggagcctaatttttaaagttctttaggggagaattcttagatataaattttagtgaaagttctttgggggagaattcttagatataaatttgagtgtttgaagagacggggtcttcctgtgttgcctaggctggtctcaaacttctggcctcaggtgatcctcctgcttctgcctcccaaagcgccaggattatagggttgagccactgtgcttggcttagaggtaataaattttaatattctattcagaataagaaaatatagcatataagcatttgtatctttagtaaagttactgccagtttgatttttttttttgcaagttacttagcagaacatgtaattcacagtaaagatgattctgtgttgtaccatattttaatattcctgttttgaaagaatagtagagagaaaatgggtggcctgctcagtgattgcttttcgtagtcttggtgaatgttacaggagattgaatttatagataaaagcacagtcatcatagtttccacagtacattgcagcacatttagcttgctagcctaaaaatctgatcatgctgagtttcttttaaagaaagttaattttagaacttcaaactagaaccagtttgaacctcaagttgaccgttgtctgagttttaaaaatctcttcccattttcaaagatttttcaaatggatgtaggagaggaccaaggaggtaggctatagctgtagaacaacacagtcctattttcagaaacgaacagacacacgttttaggtcaggcacagcccatgtatccaggtgcatcaaactggggatgctaagttcaaaagtgcgtctgttttgaagatttcatctgaaaataatgtgtacactttcattactaccagtttgcattcaaaatagtttttgagactctttaaactcttctggatactttaattttccctttggaatagtgtgtaaacacagtccggatgaactttactactgatacctcacttgaggttgacaggagtggccagcagttagtgcctatggtcatgtaatacactaagtcaatacctgtggagtgaaatccggtctctataaaaaatacaaaaaaaatggcgtgagccaccgtgcccagcatggtatttatgattctaagtgccatttcaaaaatctgtttgctcttttttattctctggtccactaaagagtaatctttactgtgggctttatttcatatttttatttgtcctaatactaagtggtagcttctcatttctctgtttcttgattttggagagcaagtctatgcttatctatagaaataatcagtttgtaaacttatgttctccttgaagagtttttgaattttcatgtggcaacttatttttctgttcacattcttgacagaatagaccctcccaggtcatctgcacttctgatatctt

SEQ ID NO: 406083 - DNA, 2593 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcagttggttgggacctctagatcaccgcc

SEQ ID NO: 406084 - DNA, 1826 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggctgagcgcaccttcgagatgagaccttcacttcaggtggtaatgcgcctggtggattgtgcggtgacggtggagatttctcctgtactgccactgcgaagatgggacacttaacaaaagggaatgtgagggaaatactgatggcccaagtgtaaatgtctatgtggaactttttgagcacccatgtttacctgccgtgaattagattttttaatttgttgtatctgtttgaaatatatctatttacaaaacaacaaaaaaaaaaaaaaaactttttgggcgccctgggcccccgaaaaaagttttttaaaacccttgtgtttggggggcgcggggcccccttggttttttgacaccggcgcccaaagggg

SEQ ID NO: 406085 - DNA, 1686 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggctgagcgcaccttcgagatgagaccttcacttcaggtggtaatgcgcctggtggattgtgcggtgacggtggagatttctcctgtactgccactgcgaagatgggacacttaacaaaagggaatgtgagggaaatactgatggcccaagtgtaaatgtctatgtggaactttttgagcacccatgtttacctgccgagtccgctgcattggggatcctgtagggtcgacg

SEQ ID NO: 406086 - DNA, 2025 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacaggggagtggacagtttcctgttagctgcaacaacaatccaatggttgaagacaccaaacagcaggagagtggttctgttggaccaaaagaaatagaaatatatactgtgtcagcaatgcagaccccctgtcgttgcaggaatcagtatgcatattatttctaacataagtttttctcagatgttttgcactttgttgtccagtgtctttttaaaaatgttatactataatttgcatatcttgggcaagtttgtagatacaagaagtgttttgggtatattctgtggacatgaaaaatgtaagtgcaatctttattctgatttgaagctactgtttttcatatcattttaacagactcagaatgaagaccacagaaaccagagcaaccaagtcctgggtaaaagattccatgctggagtgactgggctgagtcagaaccacatttactagtttctcagtgtttactgctagtcgtcctctttgtggtatatggggttgaaaatattactgtagcatgtcggattatcaccaaggcatattcagc

SEQ ID NO: 406087 - DNA, 1281 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaagttaaataggaagatgccttttttagaagtttagcatatttagtttatctcccaaatcttgcttagaaatcaaatgtatataagagaagttagttacagagctagattgattaactacttctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagaacacggtctctcatgagagaccgtgttgcactgaccatcacctccgtccactgattatttggtgtggatcctgtagcagggtctgaactctgtaggt

SEQ ID NO: 406088 - DNA, 927 bp, Homo sapiens
tttttttttttgcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcacagagcagtgtacattcttgtcttccaggggaacttcaacatggagttacttttgatccctcagttttaattcagtgtctaaaggtttacaagttcaacttactctattttattcagctctttcacttactctgccatcacttcctacttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaatacaatactcctgcaggttttcccaagcaaggccaaaacaatcaaaatctgacagaaaaacacagctgttcagctctggaatctgatgataggctactttttaatgtcaggacatccttctaaacttccacttacagtgtcacatgtaagcatgaaggctggctcgttggtgagccattgctttgtttttaggaagacagttatgaatgccatggacaatctcagtacatgttgtttgttatgattttattcacgctaaaggaatgggtattaaaattaagtgcatataatatagaattcagtttcaagtctgaagttagcgtaaatttagattcttcagactaacataaaacatgattttgagaccagcctgagcaacatctctcaaaatt

SEQ ID NO: 406089 - DNA, 491 bp, Homo sapiens
cttagaggacccctctctccacactggtacactgcctctctccacactgggtctctctccacattggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406090 - DNA, 3342 bp, Homo sapiens
tgtaggtccgttttaatactgcattatacggatgccagtgtttaatggcagagtctcagaacttttctacaggagaggatttcttgagaagccatttattctgtggtaaccagattttcagctgggctacatgtattttaacttaattatttttatcttaactgggatcatcagatagcttgagaagcatcgatagccttatataagcaaattcagtgactcactctagaaaagtctctcttgcctagtttaggaagtaggcacagttggctataacaaagcctagaatgtgatgttagtagactattctaatgccacaaagaatactgcttcactttaattaaaagaaattttaattaaaatggaattgtcttagtttggatcataattgaccatttatgacccacctttgtttgtttaccatagagccctgtctagaaaccagattttcattaggtcaaatacaggtgatgagcatatttaatattagtgttaaattcatttgtgacttttgcccttagcaaaatgtaacctagatttacttttagctattcattttgaaattcgtggtttctttatatttgttcatttttttgcccatcagaataatatttcagttacaaaatctaccagaattatgactctgaattcatattttctgattttaggtcctctgaattctagtcatcctcacatcctacttttgcctcctcttttttttttttttttttttttctaaaaagagacagagtctccctttgtcgtccaggctaaagtacagtggcatgattatagttcactgcaacttcaaactcctgggctccagtgatcctcctgcctcagattcttgagtagccaggactataggcacataccaccatgcccaactaatttttaaaaatgttttgtagagatggggtcttgctgtgttacccaggctggtctcaaactcctgggctcaagcagtccttccaccttggcctcccagagcactgggtttacaggtgtgagccactgtgcagcctccttttatctaattgtccccacagcagacttgtctggtcttggctattttccggttgttaaggtgtttcaggatggaggaatcagttcctgagatagttattaagttctgcctgctagaaagggacagtaagtgggttgatatcattctagacttgttaagaaattgttcagaattttgattgtttttcatagcagcttgattaaaatacagattttaataatttccttactacttttataggtagtgctttcaaataaaaccagtgtttgctaaatccaaatgtctttctcccttgctaaattatagcaggagcatgctaaatatttcatcagactactggaatgatggttttacattttaatgtttgaaaacataattttggttcaattgcagtgtaaaactattctcagtaactttaaacttgaaaacttggcaccaaatttatttaggtagaaactctttaaaaatagtttcttcctattattaactgaagaatatatttaagaaagtcttcataattaaataagagtttggataccaaagggttaaaaatacacatgtatttcttttgctgaagatatcttagatgtttgctaatgttttatctttacaaatggacaatttagtaatgttttttatctttttttaatgattccatgtatttgcttatttccatctaggaatagttactaatgtatttgagatacagcataccaaattttaaagtaaccagaatcgtgagttgatggtttttagtccatactgttaaacttatgttgaaatattgacatatttaaattggcttcatgctaaaaaattaccaaaggtaatttaaaaggcagtgttttagagcagtagctcatggtcaaggtggtcacatgacaatggcttaagctcagtgtgcttctgcaccttatgttgtctatgtatttttaatccaaatgttgcctgcaaatatgtgatcccttattatttaagtttcctgtattatgaaccattgcccgttttaaatcacacagaagattctgaatctgtaaaaactacacatgtcaatgttttacagctacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgaggtatttgttgcggtgattggttttaacgctaatctaggaattcagatagagatgctttagatttgcatgctttgcttacctaatttatgatatctacctttctatttgtaaactaacaatagctaagttgagatcagaattttaacagaaatattatttatataaaaattgttatcttttattgtcacatggcattaacaataagaaaacatcctgaaggtgatgtgacaactcggattctaaaaattatacttcaggtatttcctgatccgtggtttttcaaaattgaaacaaagtcgttctcatcagaatggcttctcctttgttctggaattgtggcactataagtggaaactggtgggaccctggctggcttcagagtggagcctaatttttaaagttctttaggggaggatcacttgaggcctggagtttgagaccagcctgagcaacatctctcaaaattataaaaaaaaaaaaaaaaaagtagccaggcatggtagcacatgcctgtatacctagctacttgggaggctgaggctaaggaggatcccttagcccaggagttccagggtgtggtgaactatgattgtgccactgcactccagctggggcaacagggagatactctgtctctttaaaaaacagtggttactagatggaaagataaattctagtgttaccttgcactgtagggtgactaacagtaattttttattttttttgtatggctaattcagtacaaatggaaagtgtttgaggtgatgcatatgcaattatgctggttttttttaatccctatacattgtattggaatttacaatgtaccccataataaaggatagaggaatatttacagtatcatctatttggttaaatgttattcagcagttctggcctgctgcctttttttgtataacctatggcccaagaatggtttctacattttttaatagttgagcaaaaatcaatagaataatattttctaatacataaaattagatgaaatttcagtttcagtgttcataaataaagctttatgagagccatgctcaattgccttgaggctgctttcagcctacaacaa

SEQ ID NO: 406091 - DNA, 1537 bp, Homo sapiens
ttttaatgtgagcagggatagtagagatgatgaatgtaggtaaggagaggaaatgagaatgaggactttcaggggcaagagatggtggtgtcattttgtgttgtgttcctgagtcaggtaccaacagatttcctctgagtagaatataaatgctaacaaattaaactgtatgttgtatacattcagcccttggtaacaaggaaaatgatagaattgaaatgttcttgtacctcactagaagcagagaaagggtgctggatatttctgtttccgataatgctgcatagatagtgccacttaaatgtagagcaaaattacagtctcctctaagtaattcctccagttaccatgtgtcctagattccgatacctgtccaatacaatttctagaactttttcacctccccatcatgtctgccttctagtgccccaaaattatgtgagatgctagaagttgtttgacctgtgattgttcttgcttccttggtccttacgtacgagtacatagcatgattgggccagaatccgtcttttgagctcttctagtaaagtaagttttgagataatacctaagaccacatggaaatttggttggtctaagtagaggacaagcacgtatttaactacctttggcaggggaaaaagtgaagtgggagagcttaccagtgctacctatgtgtaggctgacactctgaaacttcagtctccaggaatctccatatgttggcactattttgttgattatttttctataaggttatatttctttggaagatcagtaaacttgctgttctaacccaaattcagtgtagtcttcagcttctgaataaggaataaaggaatcgaatgtgctttggatgttcttttaacaatttcagaatgttggcatgccctttgagcatctaaacttccctcagcgaattggtatttatttatttatttagagatagaatcttgctctgttgcccaggctggagtgcagtggtgtgatctcggctcactgcagcctctgcctcccaggttcaagcgattctcctgcctcagcctcccaagtagcagggactataggcatgtgccaccaccacactccgctaattttttgtatttttagtagagccagggtttcatcatgtaagccaagctggtctcaaagctcctgacctcaggtgatccacccgctttggcctcccaaagtgctgggattacaggcgtgagccaccgtgcccagcatggtatttatgattctaagtgccatttcaaaaatctgtttgctcttttttattctctggtccactaaagagtaatctttactgtgggctttatttcatatttttatttgtcctaatactaagtggtagcttctcatttctctgtttcttgattttggagagcaagtctatgcttatctatagaaataatcagtttgtaaacttatgttctccttgaagagtttttgaattttcatgtggcaacttatttttctgttcacattcttgacagaatagaccctcccaggtcatctgcacttctgatatctt

SEQ ID NO: 406092 - DNA, 1243 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgaggccctcaagtgtctcttttccaccaggtgtggctgagatgggctcaggtgccagtctgtttttccttctcagtataagagccaccactcaagaccctgcattatggtgacttccctggactgagctttcatattttttttagaagaagtatttagcctgagctacctagccaaaaacaattataagcctttggcctggagatagagcacaagtaatcattattcattgctattgtatatgtggttatttagttttaacatcgagataaaatgtcagttttgtcagtaagttaatttgtaagttgcttcttgatttctgcacattttaataatttaccccatttagtccaccaacgtgtaacagtttgaatctccaaaataatggtactaggtctattttattccctgtaacgctgctcatatggtaaagtgtagtcctagcaaatcataaccgtttcttttttttaagacgttcaaggagcatagaattaacttatttaaagttagtttttttcattcagaatggacgagattattaactcttcatattacatgctataatatttaggagataatataaatttttccttttcctgtgaatagattaaaagctgccttatatcagtattattaaattcatttgctctt

SEQ ID NO: 406093 - DNA, 967 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagttgcatctgtaagataacgcatttcagctgctgtgcatcgtattaaattttctagcaccacacgtgagtatgttaatggactttctttttcttttcttattttaaatcttgagttttggtgccaagttttctgtgtgtgaggctctgtttctggcttatatgttggtcattattatttgccattgtttacatctaaaaattaaaacgcacaggattaaatctaacttgtgaccaaactaaatgtttgtgtactttaaaggacctaaatctctgtgtatggagttttcagcaagcacgtgaagttgtcaccatccttaatcttgcttatatggtagttccatttttccactgcccccaatatttgagtgctg

SEQ ID NO: 406094 - DNA, 815 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgattcacagcattaacaaaatggatgcggttttcacccttaaatgttgagtgtaagctatagagctataataaccaaaataaccaatatcagcttttttgttttaccttaagtgttatgaataattcatgaaaattaattataaaccacattattctaatcagaaatgtgaacatttagacttcggaggaaataaaacccacaaaactagtttaaacctttg

SEQ ID NO: 406095 - DNA, 2557 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagaatagttactaatgtatttgagatacagcataccaaattttaaagtaaccagaatccctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406096 - DNA, 2547 bp, Homo sapiens
ggcggaagcgggatcgacggcgcctgtgccccgaggggcctagggcgcctgtgcggcagcgctcgcggcccggagtcgcggcggggcagccggggggcgcggggcggaagcgagggtcttgctctgttgcccacgctggagtgcagcggcgtgatctctgctcactgcaacctccacctcctaggttcaagtgattctcctgtctcagccttctgagtagctgggattctagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgactacgtaattcgaattgacttgattttttcaagtaatcctagaaagggggagcattccatatagaaactgctgaaactgccacaggtgcttctccgaaaaccttacagttgtggcattgaatgttcagtatcgcttcctttctgcacacgaggcatactgttgagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406097 - DNA, 2737 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagtttatttcacagagcagtgtacattcttgtcttccaggggaacttcaacatggagttacttttgatccctcagttttaattcagtgtctaaagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacaggggagtggacagtttcctgttagctgcaacaacaatccaatggttgaagacaccaaacagcaggagagtggttctgttggaccaaaagaaatagaaatatatactgtgtcagcaatgcagaccccctgtcgttgcaggaatcaatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtactttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 406098 - DNA, 1267 bp, Homo sapiens
agcgggcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagtaagtgtctttcgtttattctttccagctaaagatgtagttgaggatgttttgtttaaaggcagtacataagcaggcaaaagtcctaaaactttgttttcaaaattagtaatgtaattttgccttttagaacagttggtgttagtgaggaaaattgtgtggactagaataaaagagtttattgaataagaaaaaaaaaaaaaaaaaaaaaaaaaaaaaaaaaaaaaaaaaaaaaaaaaaaaaaaaaaaaaaaaaaaaaaataaaaaaaataaaaaataaaaaataaaaaaataataaaaataaaaaactcttaattttattttttcctcttttcttttcaaatttctttttacttctctattttttaatctcttctttttttattttcttttctcttctctcttcctacattatatcctccctctcttattccctttcctattaaccttccccctttttttatctaatcctttttcctctatcattatttttctcttattttcttctttcattttacttagtctttttctttcttctccttctttactatttctctcttccaactttttttccatatatatttattcattttcttttttcactctctatctttctcttccttctcctcttacatttttttctataaacttctttctacttctcaatatctc

SEQ ID NO: 406099 - DNA, 2102 bp, Homo sapiens
gggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406100 - DNA, 631 bp, Homo sapiens
gctagacccttggagctgggataaaggaccttttaacccactgagaggtggctgcaataaatggaattgccctgggggtgagcaacagaaactgggtcaagtaagtttctattttttgcagcacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406101 - DNA, 654 bp, Homo sapiens
ggggtcagtgttgggttcaactaatcttgattattatatgggtgagcttccatgaggatctaggcaagggcatgatttaagctgccattgctaggattaagagcaggaaggagcatcctcctcttctaccaagtgggatgtctgtggagaggaggctgaaggtgcttcctttgtattagttgttggtgccctggagttttcagtatcactgtattaaggcatgggatggttacagtgacaaacgatgggggcaagttgggttgaagcctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406102 - DNA, 1448 bp, Homo sapiens
  misc_feature (1126)..(1126): n is a, c, g, or t
  misc_feature (1138)..(1138): n is a, c, g, or t
  misc_feature (1145)..(1145): n is a, c, g, or t
  misc_feature (1163)..(1163): n is a, c, g, or t
  misc_feature (1174)..(1174): n is a, c, g, or t
  misc_feature (1176)..(1176): n is a, c, g, or t
  misc_feature (1181)..(1181): n is a, c, g, or t
  misc_feature (1189)..(1189): n is a, c, g, or t
  misc_feature (1195)..(1195): n is a, c, g, or t
  misc_feature (1221)..(1221): n is a, c, g, or t
  misc_feature (1243)..(1243): n is a, c, g, or t
  misc_feature (1254)..(1254): n is a, c, g, or t
  misc_feature (1274)..(1274): n is a, c, g, or t
  misc_feature (1290)..(1290): n is a, c, g, or t
  misc_feature (1300)..(1300): n is a, c, g, or t
  misc_feature (1306)..(1306): n is a, c, g, or t
  misc_feature (1318)..(1318): n is a, c, g, or t
  misc_feature (1345)..(1345): n is a, c, g, or t
  misc_feature (1347)..(1347): n is a, c, g, or t
  misc_feature (1350)..(1350): n is a, c, g, or t
  misc_feature (1368)..(1368): n is a, c, g, or t
  misc_feature (1386)..(1386): n is a, c, g, or t
  misc_feature (1439)..(1439): n is a, c, g, or t
gggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcagagacaggtggttttcgtggacccatgtggaaatgcgcactgtctgttgcgcagtgaatgctgggactccaaagaggattttcaccatatctgtattcttcncttacaaacaangggttcntgcgtgtaccctggctgngggattccagnanggagnaataaagnatgggnccccctttgacgcaattttggggggnggctggaaataaactttgggcngaaatggtccntcatcaacaggcacacgtcnaaccaaaaaaaaaaanaacccctganatggcnggcggctctggnggcaaatggggggctattcagaaaatntngtngcccaacaacaacaaccncagggcccctattctggngggaatgcaactggaaccaaaacaaggaacaaccgggcccacccaatccttgntgcagaagg

SEQ ID NO: 406103 - DNA, 283 bp, Homo sapiens
cggaccggcatactggacttctacatctagatgtagaaggtacacaagtagtaggataactcacaggatggatccactggaggttaagacatgtggtaagacagtgtaataggaagctgctcagttggagaaagtaaggaagcaaacattgttaccgtgggggcaatggagaggacagtgaggagccctttatcctgataagggtggctttgaggtaaaggaaggaaagaggatgccttgagaggccccactgtattagagaggacctggaagtccaggatgc

SEQ ID NO: 406104 - DNA, 1251 bp, Homo sapiens
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406105 - DNA, 1150 bp, Homo sapiens
tcgaatcgagctcgtaccggtgtttatcgatgccagctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406106 - DNA, 2048 bp, Homo sapiens
gggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406107 - DNA, 1985 bp, Homo sapiens
gggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406108 - DNA, 1392 bp, Homo sapiens
gggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacgtgaggagagaggggtgcagaggggctaccaggaagtgcagttaggagggcaggccagggaggatcccacagtggcccaggggtt

SEQ ID NO: 406109 - DNA, 1211 bp, Homo sapiens
ctctctccacactggccagcaagaaacaacacttcccacaaggggaaacctggttacagcagctgatctgagatcctgttctctggccctttgtagacacccttcctcttcctcatttcttcctctttcttttccaagagtccgcaattacttttgcaccagtttaatatttagtctgtgctattgctgctctggtggtgtggttgatgttgctgcgtctatgtttgagggtgagaggggagcgtgcttgctttgaaatgaggatgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttcaaacactgtttgaactcagtgtcgggagtagttaaaggtatcgtgagaagttgcacacagctttggggactcttggaaaagaaagaggaagaaatgaggaagaggaagggtgtctacaaagggccagagaacaggatctcagatcagctgctgtaaccaggtttccccttgtgggaagtgttgtttcttgctgggcagttgggaagggaatggagaacagagaagagagtggaaatcacatgctcacttgaactttcctggggaacgtctcctcacagcgtgcacaagagcctccctttagaaatggagtgttcattttatcatgggaaaagaatctgagtgggacatgattcagaacaggaccggcccaaggaagtgcaggggctgtggagtgggatggagacaagctctgaaaggacacatgggagatctagatgtagaaggtacacaagtagtaggataactcacaggatggatccactggaggttaagacatgtggtaagacagtgtaataggaagctgctcagttggagaaagtaaggaagcaaacattgttaccgtgggggcaatggagaggacagtgaggagccctttatcctgataagggtggctttgaggtaaaggaaggaaagaggatgccttgagaggccccactgtattagagaggacctggaagtccaggatgc

SEQ ID NO: 406110 - DNA, 475 bp, Homo sapiens
cagtgaggagccctttatcctgataagggtggctttgaggtaaaggaaggaaagaggatgccttgagaggccccactgtattagagaggacctggaagtccaggatgctaattctggggagatggattccccaggcttactctaggagtagaggtccatgggacgagggtttgatttgagaaagatcattttcttgggagtgggtggtgtgagctagacccttggagctgggataaaggaccttttaacccactgagaggtggctgcaataaatggaattgccctgggggtgagcaacagaaactgggtcaagtaagtttctattttttgcagcacctgggctgtcccccatgcagaccctgaaggtttctgtgtctgcagtgactctgggcctgggcctcatcatcttctctcttggtgtgatcagctggcggagagctggccactctagtgagtgactcgctgaactcccatc

SEQ ID NO: 406111 - DNA, 1949 bp, Homo sapiens
gggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406112 - DNA, 1314 bp, Homo sapiens
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406113 - DNA, 1035 bp, Homo sapiens
ggtgtagtacgtgccctgtgccggtcatgtaccgcagcatgacgaagaggagggagactaggatcgatggccacagcatcaatcgacacctgcaatgaatacaatgtccattatggtgggggtggaggtctccattctgccatccggccatccatacattcctggaacaggctctgcaatggtggtagtatgcattgtggtggaggggtgaacattcgtgtccactgaccaacacgacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406114 - DNA, 2066 bp, Homo sapiens
gggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaatatt

SEQ ID NO: 406115 - DNA, 2161 bp, Homo sapiens
ccgggccccgtcctagttcaatcaatcaagaaaatcaagagtacgaaggccttgtgcggtctggacggtctttccacgtctcaggtgcagttaagccagtcacactccatccacctacccgccatgaaaaattatttgttcagcaggaattgccaagtcaaatacagccatataaagccccccttcgacgtgccaggtgtgcctccggagagcagccaccaaaaccaccagcagcccgtccgcgccgggaaatgcgccctcgctggcttacggggccactcagacagttctaagtgcctttccctgtaacgcagaggcacacctgccttccctcgggaaacagcggcccgacgtgcgcccgcaacgcgtaaagcgtcaacagctgaaaccctcggaatcctccccgaacagaaacaaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttac

SEQ ID NO: 406116 - DNA, 1599 bp, Homo sapiens
  misc_feature (1459)..(1459): n is a, c, g, or t
  misc_feature (1464)..(1464): n is a, c, g, or t
  misc_feature (1468)..(1468): n is a, c, g, or t
  misc_feature (1472)..(1472): n is a, c, g, or t
ccgggccccgtcctagttcaatcaatcaagaaaatcaagagtacgaaggccttgtgcggtctggacggtctttccacgtctcaggtgcagttaagccagtcacactccatccacctacccgccatgaaaaattatttgttcagcaggaattgccaagtcaaatacagccatataaagccccccttcgacgtgccaggtgtgcctccggagagcagccaccaaaaccaccagcagcccgtccgcgccgggaaatgcgccctcgctggcttacggggccactcagacagttctaagtgcctttccctgtaacgcagaggcacacctgccttccctcgggaaacagcggcccgacgtgcgcccgcaacgcgtaaagcgtcaacagctgaaaccctcggaatcctccccgaacagaaacaaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttacaaaaaaaaaaaggggggggntaaanaatnctgngggccaagttagcgtacccggtttggaaaaggggcctataggggggataaagaggcagggggcgttaacggggggggaaggctggatttggagacctttggggcaatggacccacagataatccgaa

SEQ ID NO: 406117 - DNA, 958 bp, Homo sapiens
tgaggcagaagaattgcttgaacccaggaggcagagattgcagtgagagcgcgcaccactgcactctagcctgggtgtcaaagcgagactctgtctcaaaaagtaaaaatcaaaagtttgacttgggcaccactgaagggttttaagtgtgagagtgaaatgccttaagcaaggtaaggttagccttacttgcccagccactaaagtaaaactcatgtcccaagtgacatgtattttaaatttgtcttagagagtttaagtttcccttttgaacaattgatccctggaagagcctatttaaaggacaggtgactttttcattccatttagggagttatgctattaagtggttgtgctggaagatattttatggtgtggtatctgaagtttacaatatgtcatatattgttttttagtatattttaaatatactaatcgcttaataattttacttttcattgttaaaattccatgtcctaataattcatgtcctgaatctagtaacatgttataaaatatttttatcattctttccaataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttac

SEQ ID NO: 406118 - DNA, 2228 bp, Homo sapiens
ccgggccccgtcctagttcaatcaatcaagaaaatcaagagtacgaaggccttgtgcggtctggacggtctttccacgtctcaggtgcagttaagccagtcacactccatccacctacccgccatgaaaaattatttgttcagcaggaattgccaagtcaaatacagccatataaagccccccttcgacgtgccaggtgtgcctccggagagcagccaccaaaaccaccagcagcccgtccgcgccgggaaatgcgccctcgctggcttacggggccactcagacagttctaagtgcctttccctgtaacgcagaggcacacctgccttccctcgggaaacagcggcccgacgtgcgcccgcaacgcgtaaagcgtcaacagctgaaaccctcggaatcctccccgaacagaaacaaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaagatggagtctcattctgtcagccaggttggagtgcagtgggaagagcttggttcactgcaacccacaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttac

SEQ ID NO: 406119 - DNA, 1426 bp, Homo sapiens
aaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaaaagaataggatcaagatgtataaactgttgtttaattacgtgagaaacatcttcagtggccaaggaaactgtccatttctctcagaaagcaaatgaaatgctgcagctatacccagaccttttataggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttac

SEQ ID NO: 406120 - DNA, 218 bp, Homo sapiens
ctggcacattctagttgtaataaatgttactgagtaacaataattagttttcttcttttttttctattggttttatgcagctaagggagaacattgagcaattcttcaccaaatttgtagatgaggggaaagccactgttcggttaaaggagcctcctgtggatatctgtctaagtaaggtatggtattaaaaacattaatgattaatatttggctgt

SEQ ID NO: 406121 - DNA, 1439 bp, Homo sapiens
ccgggccccgtcctagttcaatcaatcaagaaaatcaagagtacgaaggccttgtgcggtctggacggtctttccacgtctcaggtgcagttaagccagtcacactccatccacctacccgccatgaaaaattatttgttcagcaggaattgccaagtcaaatacagccatataaagccccccttcgacgtgccaggtgtgcctccggagagcagccaccaaaaccaccagcagcccgtccgcgccgggaaatgcgccctcgctggcttacggggccactcagacagttctaagtgcctttccctgtaacgcagaggcacacctgccttccctcgggaaacagcggcccgacgtgcgcccgcaacgcgtaaagcgtcaacagctgaaaccctcggaatcctccccgaacagaaacaaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttac

SEQ ID NO: 406122 - DNA, 1314 bp, Homo sapiens
ccgggccccgtcctagttcaatcaatcaagaaaatcaagagtacgaaggccttgtgcggtctggacggtctttccacgtctcaggtgcagttaagccagtcacactccatccacctacccgccatgaaaaattatttgttcagcaggaattgccaagtcaaatacagccatataaagccccccttcgacgtgccaggtgtgcctccggagagcagccaccaaaaccaccagcagcccgtccgcgccgggaaatgcgccctcgctggcttacggggccactcagacagttctaagtgcctttccctgtaacgcagaggcacacctgccttccctcgggaaacagcggcccgacgtgcgcccgcaacgcgtaaagcgtcaacagctgaaaccctcggaatcctccccgaacagaaacaaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgaggtgcgtgaagtgggcaggccctgtcagtctcgcgttcttcttggaagccgagacgcgggccaccctcggtcctcatgctcccggctgctccctaggcgaaagcccgccttgggggttcctgaactcccagccttgagacctaccatcagcccgaccccagggtcctgtgcgtcttcctacggacccgaaagaagaaagctttgagagtgtaccttttcgctatttttcctccccacttttacgactttgaatttacagtgttgctatttagtagtggatggcaatcccgcctgtttcaagtttctgaaattttgcgtgaaacaagcgcaaatgaagcagctgtccagttggggaacagtaaaataactgcagttctgttcagtgaaaaaaaa

SEQ ID NO: 406123 - DNA, 1883 bp, Homo sapiens
ccgggccccgtcctagttcaatcaatcaagaaaatcaagagtacgaaggccttgtgcggtctggacggtctttccacgtctcaggtgcagttaagccagtcacactccatccacctacccgccatgaaaaattatttgttcagcaggaattgccaagtcaaatacagccatataaagccccccttcgacgtgccaggtgtgcctccggagagcagccaccaaaaccaccagcagcccgtccgcgccgggaaatgcgccctcgctggcttacggggccactcagacagttctaagtgcctttccctgtaacgcagaggcacacctgccttccctcgggaaacagcggcccgacgtgcgcccgcaacgcgtaaagcgtcaacagctgaaaccctcggaatcctccccgaacagaaacaaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggtaagattttaatagtcatgtaatgtggtgtctttgatagcattctaatattcctatcaaactcagagtaataaagtctaacattgcttacagtgctatgcacagtctgaccctttgctataatggtcttcttgttcctt

SEQ ID NO: 406124 - DNA, 1053 bp, Homo sapiens
gtcttgaactcctgaccttaggtgatccacccttctcagcctcccaaagtgctgggattacgggcgtgccaatgtgcccagtctagcttttttggtcttgtttttttgtttctgagacaggattttgtgttttttttctgtctcagacagctctgttgcccagactggagtgcagtggcatgatcacagctcactgcagccttgacttgttgggctcaagtgatcctcccacctcagtcttctgagtagctaggaccccaggcatgcaccaccatgcctagctaacattttcgaagagacgggggtctccctttgttgttcaggctggtctcagtcaaactcctgggctcaagcgatccctgtctttgcctcccagggtgttaggattacaggcatgagccacgtacctagtggtcttctgctgttcaaatggaatcccaaaccttacccttctgtgttatttccatgtttatatgagaaaggggatatagaagatatagtagtccctagacttaatgggtgtactgacttatgccatagactaaacttaagagaaactgttagtttgaaaatgttgaaggcagtaatgtattaacattggttctatttattgtcttttttttttaacttgtgattattagacattggttatatcattggtaagatggagctgtaccatcttaaaaatattctaataaactatattttcatagtagataattcatattgttatgcacaagtcatggaacagtgaactacatacttgttggaaataaaacgttcatattgaattgtgcagactatatgttaagagcaaacgtctttctacttacagaagtacgctcttcagggtcagaatttcaatcacgaggtcaggagatcgagacccatcctggttaacgcagtgaaatcctgtctctactaaaaaatacaaaaaattggcctggcatggtggcgggcacctgaggcaggagaatggcgtgaacctgggaggtggagcttgcagtgaccccagattgcgccactgcactgcagcctggagactccgtctca

SEQ ID NO: 406125 - DNA, 852 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgtt

SEQ ID NO: 406126 - DNA, 651 bp, Homo sapiens
tgccgaggcgcgggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgtt

SEQ ID NO: 406127 - DNA, 393 bp, Homo sapiens
tcggtggtagagaaagaaagggtcttttgatttttgttagcctcccaattttcagtgctgctttcttagttgtttttaaaatactactttcagagcatcaggctctcatttcccacattgctttgagtaccagtgctatttctcccttgttggcttttattctaatcatagtcattagagatgacttcatgatgagtctggagatgataaaatggaaatctttcccttccatttaaagtattaggaattctttattttaacttttaaaaataacatctttatttacaggtacaacagaatatctcgggaatggactcagaagtatgccatgtgatgctaccttaaagtcagaataacctgcattatagctggaataaactttaaattactgtt

SEQ ID NO: 406128 - DNA, 4349 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406129 - DNA, 3829 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406130 - DNA, 2747 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgcta

SEQ ID NO: 406131 - DNA, 4254 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406132 - DNA, 4392 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406133 - DNA, 3738 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406134 - DNA, 3780 bp, Homo sapiens
tgccgaggcgcgggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406135 - DNA, 4304 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406136 - DNA, 3138 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctaaaaaaaaaaaaaaaaaaaaaaaaaaaaaaaaaaaaaaaaaaaaaaaaaaaaaaaaaaaaaaaaaaaaaaaaaccttgtggcccgtttggcccaagtggtttttaaattgggcaaggtttatccttgggccccaatttggggttcattggcccaattccccttaaggggggccgtttcaacattaatgtgccgcggtttaaaaacgtgggatttggaaaaccttgggggttcccaaattaaatcgctttggagaaaatccctcttttcgccggttggcgaaaaatcgaaaggggccccaaccgtacgccctttccaaaaattggcccaacttgattgccaattggaaattgtagcccgttaatttttgttaaaaatcggggaaattttttgt

SEQ ID NO: 406137 - DNA, 3560 bp, Homo sapiens
gatctagaggatcccgacggcttcaacggaactttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406138 - DNA, 2592 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtg

SEQ ID NO: 406139 - DNA, 3590 bp, Homo sapiens
tgtagttgcagcttttcacccgaagctatttatccgagggacaccgggaactgatgtaaaaggcattctggaagctcccttttccttttggctggagagtgggggtggataaggggtgcgatggcagtaagggagaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406140 - DNA, 3967 bp, Homo sapiens
aaaaaaaaatttcaatagttaaaaatggatgctgagtttaaaaaaaaaaaaaaaaaaggttgagttgagagaataaggagattagaaaacaaaaaaggtacttagccccatgagagtttttttggtttgttttcaggtagaaaatagagttagtggattggggaggaaggatggttcaggaagaacaaagaatttaagacagttgagggcctctgaaagtggtcttggaagttcaacaaataacgtgaatgttgagctctctctggtctaagctcttaaactatgagaatatctaattatagctatttcggtttgtaagagattggcttttatgtaaagattgtctcagcatatgttcaggcatgttctctctcctaatggaatatattatttatgtgaattgtgatggagtgtgcctttaaaaatagggtgaaagtaactgaaagcagtggactcgcttgttttcttaaattaagcttatgtgactcacccattttctgtcttggtgtaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406141 - DNA, 4190 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataagtgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406142 - DNA, 3416 bp, Homo sapiens
ggaatatttagcaataatattttaaatttgagttaagcatacttttctttttacagaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406143 - DNA, 2430 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatgaactctagggctgccagtatcatgtgcagcacattaaaggtacactatccaaatagcttattaattctgtcgacc

SEQ ID NO: 406144 - DNA, 3673 bp, Homo sapiens
tgacagactcagtgtactgttgtaactataatgaaactttaaatgagatggtctacaaatttgggttacatccaaaagttagggcttttataaatgaatgtgttaaatacctttaatttgccctttgattcatgatatggtagggccacagtaccctttgcaactttacatcatatgagtaatgaaatttttatccaaaagtttaggttcctgttgtaaaaagaggaggcagggggttgtggccagattgtaaaaatcagttcctataatatttagaacttctatgctaatagatgacatttttaacattgtggcttgattattttacgtttggctttagcaagatgttggttttgatttgaataaaatacttaaaagttctttgttttaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406145 - DNA, 4284 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406146 - DNA, 4089 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406147 - DNA, 4177 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406148 - DNA, 2185 bp, Homo sapiens
  misc_feature (2144)..(2144): n is a, c, g, or t
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcagatgccggccagcnccccttttccctattcaataaaacttacaacatggttttta

SEQ ID NO: 406149 - DNA, 3370 bp, Homo sapiens
tcggtggtagagaaagaaagggtcttttgatttttgttagcctcccaattttcagtgctgctttcttagttgtttttaaaatactactttcagagcatcaggctctcatttcccacattgctttgagtaccagtgctatttctcccttgttggcttttattctaatcatagtcattagagatgacttcatgatgagtctggagatgataaaatggaaatctttcccttccatttaaagtattaggaattctttattttaacttttaaaaataacatctttatttacaggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406150 - DNA, 2966 bp, Homo sapiens
agagagagagagagagagagagagagagagagagagagagagagagagagagagagagagagacctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406151 - DNA, 1372 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgtt

SEQ ID NO: 406152 - DNA, 1231 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaataggttagcaagagagtggacagagaaatacgctatgttgtagggtaagagga

SEQ ID NO: 406153 - DNA, 2093 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctgtaagtattaagaatttttaaatttagttttaagtgaaaatccagcattgatttggttgtaatttttaacttggtctgtaggtttattttatcatatagttaattctattttggatattccatagttgtactgcatttgaaagaaaaaacataatgagttagtcatttgttacgtgtactttgtgtctatccctgtgttcacgttctagagtatagccatctctatgacctaccaaacatctctgtatctcagttcagtttttctacatagcactgtgtaaagcattgtcatggaacttcctgttatttatagagacaaagttactggctctgatatgccatgcgttgtgttactcagagatcttattctgttactgcagctgccaataatctagcttaattgtattttgatatttgattctttatagaacttcagtttatgcaaaatttgaatatatttaggcagaaagtgatattttgaatatagcaaaattcctttctatcctgggtagataagcaactatatgctggataattgaatattcagaattatggataccatctaagaatttcagagaattagagcgcactaaaacatcctggggtaagactgtatcttacacaaatatttaacttttttttttttttaacttgctaaggcgcttaaggatttgttttctaagttacatgtgtatcttcctgaaaactgtcttccctttttggtggttttataagcaacataaagagcaataatgtactaggtgagataatggtcagtaagtaatatttagaattctaaaggaaaaaatgctcttagagttagtagatgagtcgaatcaacaagtatttatttagtaattctgattctaactttagtcatttttctgtctcaaatgtgagtacatactgtgtgccaggtaataaggatacaaattgaacataataaacatccctgtcgatcttatagggaacttacactgtattagaggagacagatacctaaaacaagtgctgaagtgtgacaagatggaaaataagtgattggtgaatgaagtgctgagtaggataaattaatgggaaattgaagcagggaggattaatttagagtaattaaaatgttagtgccctaaaggtagaaaaactaaatcaaagtaagacatggcaggggtgcaaatattaagtttaatactttgaaacgt

SEQ ID NO: 406154 - DNA, 1539 bp, Homo sapiens
tatttgctgcatcccataaggttggtatgctgtgtaccatttttcttgtctgaaggcattttaaaatttcattcgtaattttttctgtgacccagtgctgttaggagcatattgtttaatttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406155 - DNA, 1116 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatccaagggacgccggtgtaccattccaaagtctttatcccttggtcacggtattgatccaaccaagtgaccctatggcgagaggccggttcttcacagccgagatagtccagaatttcggtggccttccgtgggcacctagt

SEQ ID NO: 406156 - DNA, 1095 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggtaacccgcggggacaagggcatggggtggtaggagaaaaggaaggctcgggccaagaggaaagcgtgggggtgggaaggaagcataattctgaaaatacctcttggatcacttcttccatggggggatggagaacgcagatatacttcttgaagaaatgaagtttaaagctaggaaacggagaacacttgtggcaagtgaggtgttatcctgagtgcttcagtggaatcggtgcaaattaggggtggaggagagtgacttaaggcgcctttattattttatttttttgctgcttaa

SEQ ID NO: 406157 - DNA, 897 bp, Homo sapiens
aaaaaaaaatttcaatagttaaaaatggatgctgagtttaaaaaaaaaaaaaaaaaaggttgagttgagagaataaggagattagaaaacaaaaaaggtacttagccccatgagagtttttttggtttgttttcaggtagaaaatagagttagtggattggggaggaaggatggttcaggaagaacaaagaatttaagacagttgagggcctctgaaagtggtcttggaagttcaacaaataacgtgaatgttgagctctctctggtctaagctcttaaactatgagaatatctaattatagctatttcggtttgtaagagattggcttttatgtaaagattgtctcagcatatgttcaggcatgttctctctcctaatggaatatattatttatgtgaattgtgatggagtgtgcctttaaaaatagggtgaaagtaactgaaagcagtggactcgcttgttttcttaaattaagcttatgtgactcacccattttctgtcttggtgtaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggcaagtattttccctcaaaatctgttagtatagatttatgctttatttcaaaggaatagagcattcttggaagatagggttctgtgtaggctgtatatatatgttgaattgcactcatgtatagatgctgactcttaacctttggtttaaagagctagacctcagtttgagctttgtaaataggaataaggtttgccttttctttaatgttg

SEQ ID NO: 406158 - DNA, 1581 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctataagcaactatatgctggataattgaatattcagaattatggataccatctaagaatttcagagaattagagcgcactaaaacatcctggggtaagactgtatcttacacaaatatttaacttttttttttttttaacttgctaaggcgcttaaggatttgttttctaagttacatgtgtatcttcctgaaaactgtcttccctttttggtggttttataagcaacataaagagcaataatgtactaggtgagataatggtcagtaagtaatatttagaattctaaaggaaaaaatgctcttagagttagtagatgagtcgaatcaacaagtatttatttagtaattctgattctaactttagtcatttttctgtctcaaatgtgagtacatactgtgtgccaggtaataaggatacaaattgaacataataaacatccctgtcgatcttatagggaacttacactgtattagaggagacagatacctaaaacaagtgctgaagtgtgacaagatggaaaataagtgattggtgaatgaagtgctgagtaggataaattaatgggaaattgaagcagggaggattaatttagagtaattaaaatgttagtgccctaaaggtagaaaaactaaatcaaagtaagacatggcaggggtgcaaatattaagtttaatactttgaaacgt

SEQ ID NO: 406159 - DNA, 1450 bp, Homo sapiens
cgcggcctctcctgctggaggaggagggggaatgggcgcgtctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctataagcaactatatgctggataattgaatattcagaattatggataccatctaagaatttcagagaattagagcgcactaaaacatcctggggtaagactgtatcttacacaaatatttaacttttttttttttttaacttgctaaggcgcttaaggatttgttttctaagttacatgtgtatcttcctgaaaactgtcttccctttttggtggttttataagcaacataaagagcaataatgtactaggtgagataatggtcagtaagtaatatttagaattctaaaggaaaaaatgctcttagagttagtagatgagtcgaatcaacaagtatttatttagtaattctgattctaactttagtcatttttctgtctcaaatgtgagtacatactgtgtgccaggtaataaggatacaaattgaacataataaacatccctgtcgatcttatagggaacttacactgtattagaggagacagatacctaaaacaagtgctgaagtgtgacaagatggaaaataagtgattggtgaatgaagtgctgagtaggataaattaatgggaaattgaagcagggaggattaatttagagtaattaaaatgttagtgccctaaaggtagaaaaactaaatcaaagtaagacatggcaggggtgcaaatattaagtttaatactttgaaacgt

SEQ ID NO: 406160 - DNA, 574 bp, Homo sapiens
ggagcttgcagtgaccccagattgcgccactgcactgcagcctggagactccgtctcaaaaaaaaaaaaatttcaatagttaaaaatggatgctgagtttaaaaaaaaaaaaaaaaaaggttgagttgagagaataaggagattagaaaacaaaaaaggtacttagccccatgagagtttttttggtttgttttcaggtagaaaatagagttagtggattggggaggaaggatggttcaggaagaacaaagaatttaagacagttgagggcctctgaaagtggtcttggaagttcaacaaataacgtgaatgttgagctctctctggtctaagctcttaaactatgagaatatctaattatagctatttcggtttgtaagagattggcttttatgtaaataaaaaattttgtatcaatgtgtttgcatatatatttttacgaactctagctaagatgattgtctcagcatatgttcaggcatgttctctctcctaatggaatatattatttatgtgaattgtgatggagtgtgcctttaaaaatagggtgaaagtaactgaaagcagtggactc

SEQ ID NO: 406161 - DNA, 190 bp, Homo sapiens
aatttctcaaatatttgaattatatttatgttcaacttaaccattataactttcatatgttataattaatgctaagtgtacttgttcaattaggtacaataggttagcaagagagtggacagagaaatacgctatgttgtagggtaagaggatctgcactctatggtgcgcttattatggtactgccagc

SEQ ID NO: 406162 - DNA, 815 bp, Homo sapiens
  misc_feature (707)..(707): n is a, c, g, or t
  misc_feature (741)..(742): n is a, c, g, or t
  misc_feature (750)..(750): n is a, c, g, or t
  misc_feature (753)..(753): n is a, c, g, or t
  misc_feature (756)..(756): n is a, c, g, or t
  misc_feature (768)..(769): n is a, c, g, or t
  misc_feature (771)..(771): n is a, c, g, or t
  misc_feature (785)..(785): n is a, c, g, or t
tgccgaggcgcgggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagggtcttaaacgcggatagtcacacgatatctccggatggaccnaagttgccgtgggtacctaagcgaataacggctnngcgggaanctnaanacggcccttggnncntcgggggccataancactttatattggggccccccacactgctg

SEQ ID NO: 406163 - DNA, 613 bp, Homo sapiens
tgtagttgcagcttttcacccgaagctatttatccgagggacaccgggaactgatgtaaaaggcattctggaagctcccttttccttttggctggagagtgggggtggataaggggtgcgatggcagtaagggagaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgtt

SEQ ID NO: 406164 - DNA, 4740 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagacaaaaaaaaaaaaaaaaaaaaaaaaaaaaaaaaaaaaaaaaaaaaaaaaaaaaaaaaaaaaaaaaaaaaaaaaaccttgtggcccgtttggcccaagtggtttttaaattgggcaaggtttatccttgggccccaatttggggttcattggcccaattccccttaaggggggccgtttcaacattaatgtgccgcggtttaaaaacgtgggatttggaaaaccttgggggttcccaaattaaatcgctttggagaaaatccctcttttcgccggttggcgaaaaatcgaaaggggccccaaccgtacgccctttccaaaaattggcccaacttgattgccaattggaaattgtagcccgttaatttttgttaaaaatcggggaaattttttgt

SEQ ID NO: 406165 - DNA, 4184 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406166 - DNA, 3988 bp, Homo sapiens
tgccgaggcgcgggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaaaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406167 - DNA, 4264 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406168 - DNA, 4038 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406169 - DNA, 3660 bp, Homo sapiens
cggcacgagtggaaaagcgcacttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406170 - DNA, 4295 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406171 - DNA, 2983 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgaaaaaaaaaaaaaaaaaaaaaaaaaaaaaaaaaaaaaaaaaaaaaaaaaaaaaaaaaaaaaaaaaaaaaaaaccttgtggcccgtttggcccaagtggtttttaaattgggcaaggtttatccttgggccccaatttggggttcattggcccaattccccttaaggggggccgtttcaacattaatgtgccgcggtttaaaaacgtgggatttggaaaaccttgggggttcccaaattaaatcgctttggagaaaatccctcttttcgccggttggcgaaaaatcgaaaggggccccaaccgtacgccctttccaaaaattggcccaacttgattgccaattggaaattgtagcccgttaatttttgttaaaaatcggggaaattttttgt

SEQ ID NO: 406172 - DNA, 3640 bp, Homo sapiens
aagagctcagaaactgaagcacagaaacgttaggtaggagtctgagaggcgtggagaattttgcttgtgcaagattatttcagagcaaggtcgtgcggtgtgtgtagaagatgaacagactagccactttgcattgactggaaacaatggcatttacagaaagagtcaacagcagtggcaacaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406173 - DNA, 3453 bp, Homo sapiens
atcagctcgcccggatagcgggactccagcacaatgttcgtgcaggtcattggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406174 - DNA, 4290 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaaggagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 406175 - DNA, 2518 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttaaaaaaaaaaaaaaaaaaaaaaaaaaaaaaaaaaaaaaaaaaaaaaaaaaaaaaaaaaaaaaaaaaaaaaaaccttgtggcccgtttggcccaagtggtttttaaattgggcaaggtttatccttgggccccaatttggggttcattggcccaattccccttaaggggggccgtttcaacattaatgtgccgcggtttaaaaacgtgggatttggaaaaccttgggggttcccaaattaaatcgctttggagaaaatccctcttttcgccggttggcgaaaaatcgaaaggggccccaaccgtacgccctttccaaaaattggcccaacttgattgccaattggaaattgtagcccgttaatttttgttaaaaatcggggaaattttttgt

SEQ ID NO: 406176 - DNA, 1207 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgtt

SEQ ID NO: 406177 - DNA, 1569 bp, Homo sapiens
ctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataacgatcacccgactcttccgggaatggggccagagtatgcctgttattgtccctgttcgccggcctatcgttgataacgtgagtacggtcctttgatttctatcggagtccgatgaaccaacttaatatatgggacccccgagtacggtgtctacgacacgctccgggggacaggtcaacagatatggaagcgcccgcataccaactttttggctcgatgacacaccccactggagggcggctttggatgatattattgaggtgcgagctgacacgcctcggccgaccagtgcccgccagtcg

SEQ ID NO: 406178 - DNA, 422 bp, Homo sapiens
taaaccctatatgcgtcttatgtgtaccagtatagctatgaggaacagtcttattttgaggattttgagtcataggtctgtaatttatagagatctctagaattcttattgtaattttcctacttctttgataaaagaaaaataagtcagattgttaactccaagattgaaaaaaaaaactcttgaaagaagattattagttgtaactaatttgggggttctgggcacagacatctaacctggtattgtaaggcagaggctcccattggaatggtagtggtccgggtcagttgttcatggtgtaagctttgcacagtgtattaacattgggagggtctggcttgaaaatttggccaccctcagcctctgaatgtttattaaaataaatttagtctttctttgcttaatataaaatagtgcca

SEQ ID NO: 406179 - DNA, 3019 bp, Homo sapiens
tgctagccttgtttcgggtctaccttgtctctcggctctagcttgtctctcggctctaccttgtctctcggctctaccttgtctctcggctctaccttgtctctggctctaccgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgcccgatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagatggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcggctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcaggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataaga

SEQ ID NO: 406180 - DNA, 3479 bp, Homo sapiens
tgctagccttgtttcgggtctaccttgtctctcggctctagcttgtctctcggctctaccttgtctctcggctctaccttgtctctcggctctaccttgtctctggctctaccgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgcccgatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagatggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcggctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcaggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataagatctgttcctcatagctatactgtgtacacataagacgcatatagggttttactgaaatctatttttaactcttatgttcgtagagaaattgtttcaaggattttgagtcataggtctgtaatttatagagatctctagaattcttattgtaattttcctacttctttgataaaagaaaaataagtcagattgttaactccaagattgaaaaaaaaaactcttgaaagaagattattagttgtaactaatttgggggttctgggcacagacatctaacctggtattgtaaggcagaggctcccattggaatggtagtggtccgggtcagttgttcatggtgtaagctttgcacagtgtattaacattgggagggtctggcttgaaaatttggccaccctcagcctctgaatgtttattaaaataaatttagtctttctttgcttaatataaaatagtgcca

SEQ ID NO: 406181 - DNA, 1829 bp, Homo sapiens
caccgggatgtgtacagccaactccacacatctgccaaaaagagcaagtcatcaaggcgagcagtctcgactcaagactccctagctgcagaaaaccaatgttgtcagttgtaacaggttaatatattatttatgccacacaaaaaaggaatagtacaggcaatgatcttccaaagaaagtctttaaggcatctgtaacttctgggaatttcagggtttttatcttgccagtcagctctcactaaagtacttccacagagtgagaaggtggctcccaagtccctttggtgagttggtgccacctgcttcctctgccaccaggctggggtggggagctttggtgcttcaggtagttcttctgggacttgtcccaagggaagcaagtgtctgtcatggaaacattacccttccttgttcctgctactgtcccggtgggaagtcgacttcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcggctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcaggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataaga

SEQ ID NO: 406182 - DNA, 2851 bp, Homo sapiens
cgatgggtccctgccgggatgtgtttactgtgtttgtgtgtgtctctgtgtgtctgtctgtgtgtctgtgtctgtccctgtcgggatgtatttactgtgtgggtgtgtgtgtgtgtgtgtgtgtctgcgtgtgtatgtgtttgtgtccctgccgggatgtgttcaccgtatgcatgtctatgtctttgagacacacactcctagagacacaccccctctcacgctgacttcctggaccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgcccgatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagatggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcggctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcaggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataaga

SEQ ID NO: 406183 - DNA, 3472 bp, Homo sapiens
tgctagccttgtttcgggtctaccttgtctctcggctctagcttgtctctcggctctaccttgtctctcggctctaccttgtctctcggctctaccttgtctctggctctaccgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgcccgatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagatggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcggctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcaggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataagatctgttcctcatagctatactgtgtacacataagacgcatatagggttttactgaaatctatttttaactcttatgttcgtagagaaattgtttcaaggattttgagtcataggtctgtaatttatagagatctctagaattcttattgtaattttcctacttctttgataaaagaaaaataagtcagattgttaactccaagattgaaaaaaacaaaaaactaaaaaaaaaaatgttgtgggcggttgggccttagaagaagtttcttaaacattttgtgtgggcgggggccgaggaaggttatgggaactggcaataagctggtcccaaaggaatctttggtatgaatagggttgggtttctcaccatatataacgcgcggggaacgggtgtttgacatcagagggttgggcataggtttcaaggtcaggagtgatatcgcggcggtgggg

SEQ ID NO: 406184 - DNA, 1330 bp, Homo sapiens
tgggacaggaagtagaattatgggtgagtattaagaggggggcagccattggaagccctctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcggctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcaggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataaga

SEQ ID NO: 406185 - DNA, 1298 bp, Homo sapiens
  misc_feature (1)..(2): n is a, c, g, or t
  misc_feature (4)..(4): n is a, c, g, or t
  misc_feature (754)..(754): n is a, c, g, or t
  misc_feature (1291)..(1294): n is a, c, g, or t
  misc_feature (1296)..(1296): n is a, c, g, or t
nntnttttttgatgttccaaatgggaatttatttcaaagaggaaaagttaatattttactttaaaaaaatcaaaataatacaaataaaaataattcttggtttatggtctgtgggaagggaataaaaggacaagtagcaaggccaatgtgcatgtttagaaaacctaatcacaccagctcactcaagcagagaagctactgcatgtgcatgcattgtgtggaattaagactgggtttcttagagaaggaggagagaaagggggagagtaggagggagaggggaaaaggaggagggagaggaagagaaagaagagataaagtgggactaagagaaagagggaagagaggaagaacaaagacacagttcctttaaacatcagggcttcctgagtgcaaggctgcattaacagcttattaacaaccagccagggctgtgtggacaaagaaacttcaggatgacattatcgaagccaacatccattcaagattggagaggaagacaggaatgcccaagagtgaatctgaagttagacgttaagtgaggtgcccaatcacggctcttgggcactgctagacagcactgaaagagctgcattctccttcctcccttctccactactgagaaggcctgacaaagcaaatgcctcacatgggcaaggctggccgtcgccatggttcccttactgataccaggtgggatccccaaacattccctcaactccagttcacagcagacacgagccttgactcttangttccacaacttaattccagttacgacactggtcttcccgggggaaggccactcggtcatgcccaccttagcctaaacatgtggactgacttgactgtaggcaacggatgggacacatcgctaaggggagggaaaggcaaagaacgaggtggccccaaagagcagcaccacagacttgccaattcagccatctgagcgcttgtgggaaacatgcaggaagccgtctgcagagacagttggggtaatgcccacactctggaaaacccctaccacagagggtgctaggagccgagcgtctccccaagtaaaattctggccgccacacatgcaggcactaactactgatcaggtgcggcaggcagacagaaacccaactgctctccctcacatagaagctgtggtctgtgaatgccaccgtcatccagggactcttagaaatgtagaatcttgggcagcaccccagccctaatctatcaggatctgcattttaacaagatccccaggctacttagtaaacggctgatgggaaatggctcnnnntncc

SEQ ID NO: 406186 - DNA, 691 bp, Homo sapiens
  misc_feature (1)..(2): n is a, c, g, or t
  misc_feature (4)..(4): n is a, c, g, or t
nntnttttttgatgttccaaatgggaatttatttcaaagaggaaaagttaatattttactttaaaaaaatcaaaataatacaaataaaaataattcttggtttatggtctgtgggaagggaataaaaggacaagtagcaaggccaatgtgcatgtttagaaaacctaatcacaccagctcactcaagcagagaagctactgcatgtgcatgcattgtgtggaattaagactgggtttcttagagaaggaggagagaaagggggagagtaggagggagaggggaaaaggaggagggagaggaagagaaagaagagataaagtgggactaagagaaagagggaagagaggaagaacaaagacacagttcctttaaacatcagggcttcctgagtgcaaggctgcattaacagcttattaacaaccagccagggctgtgtggacaaagaaacttcaggatgacattatcgaagccaacatccattcaagattggagaggaagacaggaatgcccaagagtgaatctgaagttagacgttaagtgaggtgcccaatcacggctcttgggcactgctagacagcactgaaagagctgcattctccttcctcccttctccactttttcccctctccctcctactctccccctttctctcctccttctctaagaaacccagtcttgagtccacattat

SEQ ID NO: 406187 - DNA, 2859 bp, Homo sapiens
  misc_feature (2734)..(2734): n is a, c, g, or t
  misc_feature (2757)..(2757): n is a, c, g, or t
  misc_feature (2766)..(2766): n is a, c, g, or t
  misc_feature (2772)..(2772): n is a, c, g, or t
  misc_feature (2777)..(2777): n is a, c, g, or t
  misc_feature (2783)..(2783): n is a, c, g, or t
  misc_feature (2794)..(2794): n is a, c, g, or t
  misc_feature (2803)..(2804): n is a, c, g, or t
  misc_feature (2809)..(2809): n is a, c, g, or t
  misc_feature (2811)..(2811): n is a, c, g, or t
  misc_feature (2858)..(2858): n is a, c, g, or t
agcttccacccgtcctagccagggtgagaccaccctgcctgctggtggagccaggcgggcccagagcccacctggaagatggaggctgcacggcactgcgtggtccggggcagccccagggcagcagagcattccctggccttccctgctggtgccagctccttaccacagagacgccgcgtggaactcactactggcgatcgtggacgccccaggaaggcgagtggcacgaggtgtggcggggctgccacaggcagtcacggagcacccgctggtgccaggctcacccctcagatacagcctcgtgggctggctcagtggcggccctgactctccaaggtctgaggtctgctctgtcttccattccatgactcacaggaggttcaaggttacttccactgtggcagctgcctccctcctccctctccaggatggaaggaggtcctgctgtgcaaacctgcctggctgtccccttccgggacacggacggggggtttcctggcagttcctggtcctcccttgagggctaagggtccccccgttctgtggccgcctccagcacatccacccagagtccctgggcgtgaacacagccgctggggacgatcaccgcctgcccagcgtgcagccctggggctgcgtccttatctccgctcctcctgcctcctgcccagctgttcaacgtctacccatggctcggggccctgctccagctgcaccggcccgtcctgcgcaagatcgaggaggtccgtgccattctgaggaccctcctggaggcgcggaggccccacgtgtgcccgggggaccccgtgtgcagctatgtggacgccctgatccagcagggacaggtgtgtcgggacccaagacctccttgaaggcctgtaggggtcctgagggacaccccaggggagcacggctggggaggggtccataccggtcctgcaccaagctccctacctcctggctgggggcctctcagagcctcagtctccttgtctgtgaaacggggcatccatagtgcctgcctcggggacgctgagggatggctgagcccagatcaccggggcatccatagtggagcccagggctgggctgggtctgtggggtgggggacagaccccagatcatcccacgagccctgccccacgcctctgcagggggatgaccccgagggcctgtttgctgaggccaacgcggtggcctgcaccctggacatggtcatggccgggacggagacgacctcggccacgctgcagtgggccgcacttctgatgggccggcacccggacgtgcagggccgggtgcaggaggagctagaccgcgtgctgggccctgggcggactccccggctggaggaccagcaggctctgccctacacaagcgccgtgctccacgaggtgcagcggttcatcacgctcctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgtgcaattgtatactgggggtgaagctgcctgggagctgaagctgcctcccccgcagtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccgccgcgtctgtgttggggagcgcctggccaggaccgagctcttcctgctgtttgccggcctcctgcagaggtaccgcctgctgcccccgcctggcgtcagtccggcctccctggacgccacgcccgcccgggcttttaccatgaggccgagggcccaggccctgtgtgcggtgctcaggccctaggagctcccccagcccccaggtcctcctgaccactcccctcccagccctgggtcctcccaccctctctcctcccaccccacagctcggactgctctgggagggccctgaggactcccaccctcacccccacccccacagggtcagcaactgcttccggttacacccaggactacccctgcccgaccctgtgggacccccacccctctgatgctgtctgcagctcagtccctgccagcccccaggagcgcctccagggccccgcccactctcccacccctgaagctgcactcccacccacctagctccccccagggccccccagcacctacagctggggctgcagggagacaacgggtggctgcatccagccagagacaggcgcaggtgggtgtcctcagcgtgcgagccctgcaccccccaggtcctgggactcctgcagaccccactccattcccgctcctggaacacttcctgcagctgtgcctggaggcagtcggcctgcagtgccagactctgagccaagccactggggccatgcgtatgactggtgcagggaggcaaggcccacattctccttcagagacaggcactggcgccagaggcttccttggggcggggggagggcacctcagcccctgaagacaagcagcactgcagtggcaaaaatggaaacactgacccggtgcggtggntcatgcctgtaatcccagcactntgggaggcngaggcnggcgnatcacnaggtcaggagntcgagaccnncctgncnaacatggtgaaaccctgtctctactaaaaatacaaaaaattaaccgng

SEQ ID NO: 406188 - DNA, 1663 bp, Homo sapiens
  misc_feature (1520)..(1520): n is a, c, g, or t
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgacaaatacaaaaattagcngggtgtagtgatgtgtgcctgtagttcgagctactccggaggctgaggtggaaggattgcttgagcctggaaggccgaagctgcagtgagccatgatcacaccacagcactccagcctgggcaacagagtgagaccttgtttc

SEQ ID NO: 406189 - DNA, 191 bp, Homo sapiens
gacctggggtggagggggctcagctcccgcccctgccacaggtgcagacccaacgtgactgggcgccgctgtgatacctgctctccgggcttcccagggtaccatctcgtttaaagtgtgttaatgactcagtcgagcgaaggtacttgaccttcccacagccctcttctcaacgttccccctagagtcct

SEQ ID NO: 406190 - DNA, 11291 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttta

SEQ ID NO: 406191 - DNA, 11384 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 406192 - DNA, 11294 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtgggtgagagtcccaggggaaggtggacatcagggagggtggtggtggacgctgatggaccgtgccccgcaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggtaccaggctggctgggtggatgcggcccgagctcaggctctgtttggaaatgagcggtgcctggtccctggtccccggtccccatcccgactgtgtgtctgtcactgccgcaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccgacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 406193 - DNA, 11689 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttta

SEQ ID NO: 406194 - DNA, 11329 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggcgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 406195 - DNA, 11261 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 406196 - DNA, 10367 bp, Homo sapiens
  misc_feature (10329)..(10329): n is a, c, g, or t
  misc_feature (10353)..(10353): n is a, c, g, or t
  misc_feature (10356)..(10356): n is a, c, g, or t
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaagtctcgtcgctggagaagaacggntctgtgtacggcgggccggctgancanagggcgacgga

SEQ ID NO: 406197 - DNA, 10088 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctggcccagcacgaggccggcctcatggacctgcgagaggctttgaaccgggcagtggacgccacacgggaggcccaggagctcaacaggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttta

SEQ ID NO: 406198 - DNA, 9809 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagcaccagcacgaattcccttagcaccagcacgaattcccttagcaccagcacgaattcccttagcaccagcacgaattcccttagcaccagcacgaattcccttagcaccagcacgaattccctt

SEQ ID NO: 406199 - DNA, 6182 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggtgaggttaggacagcaccagactgcgaggcggctcacctgtgcacacccttccctccagcatcctccctgtgttcccttccttgctgcctccacttcctgtcaccctactcacctctcttcctgcccctgcttttcgcaggctgctggccaactcatgggcctgcctgtcccctgctgcctgtctgcctgcccctcgtcctgcctgcccctcatccgcctgcccctcca

SEQ ID NO: 406200 - DNA, 1585 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaatggtgactcgtggaaatgtccacgtggacatttccacgagtcacgatgagtcatgaataatacaaaaacggtggctaattgattatgagatttaggccctcaagacacaacactgggcagaataaagtccagatatgtaaattacagacttaaaagtttaaaatgataaaaatactaactttaacttaaattcccacatcacttaccttctagtgagctaagaaatgcaaattaaaagataacacttttctaccaatatgagctaagttttgaatgactgtctagtggtgactcgtgga

SEQ ID NO: 406201 - DNA, 302 bp, Homo sapiens
gtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgagaaccatcttgccccagcccccactccccacccactgttccctttcagctgccctgggccctgatccctgcccggtctgctcctataggtgaccgtcgggttcagcggctgtgtgaagagactgaggctgcacgggagg

SEQ ID NO: 406202 - DNA, 469 bp, Homo sapiens
gaatgtgcccccggcttctatcgggacgtcaaaggtctcttcctgggccgatgtgtcccttgtcagtgccatggacactcagaccgctgcctccctggctctggcgtctgtgtggtgagtaggggctggtggggccaggggggcagcattcactgaaggcacagtcaagtgtgccagggaagaccaggggctgcacttccaggtcaactgaggtctggggaagggtgttgcccagtgggggaccatctggccttgggcacagagtctgaggcaggggtggtgggagctgcacagactcggcagtaggatgtgggtgtccaccatagctctgactgtccactctgccccaggactgccagcacaacaccgaaggggcccactgtgagcgctgccaggctggcttcatgagcagcagggacgaccccagcgccccctgtgtcagctgcccctgccccctctcagtgccttc

SEQ ID NO: 406203 - DNA, 444 bp, Homo sapiens
tacttgatcagaaaggacctgcctatgttttcttctagaagcttggctgttctctttgtgtatttcaattcttaaggcatctggagctggtttgatgtgtggtgtgaggcagggatctaggtgctggctggcctcatgggagactggtttttctacctgtgtgtacctcctcctgccccatggtctttgtgcccctccatcccctacagggttggggggtctgttctaggctccctgttctgtcccattgagtgtggccccactgaggtgccatcctggacccacaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccag

SEQ ID NO: 406204 - DNA, 436 bp, Homo sapiens
gtgagtgagggctgggcccagatctggcctctccctccggcctcatcagctgaaagtgtccttacgggcctttcggggcagctggggcttcctagaagcttttgggagagtcatccccattggcaggtgggtaccaggaacccggggtcaggcacctggcacctgccgaccactctcactgtcctctcatccctaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggaggtgcgcctgcaggactgagggcattgccttctcggggaggtcttaggtgggactggatgcaagatggggccctgtgatgtgtgggcatccacccgtgtg

SEQ ID NO: 406205 - DNA, 770 bp, Homo sapiens
  misc_feature (174)..(174): n is a, c, g, or t
ccgggtacgccctggccgtgatgcccctggccccacccccttggttgtcaaccgccgggtcccgcggctttttattgtggagaacccccctactcctgcccgggtgtcccttgggccgcgcttgccaggttacttaccttctgggcccgcgcgcccacacggattggctttaanaacccttctctcaggtcgtcgggcccgccccaccaacttttttctgttttgtgattgtttttttttttttgagacacagttttgctcttgttgcccaggctggagtgcaatggctcgatctcggcttaccataacctctgcctcccgggttcaagcgattctcctgcctcagcctcctgagtagctgggattacaggcacacgccaccacgcccagctaattttgtatttttagtacagatggggtttctccatgttggtcaggctggtcttgaactcctgacctcaggtgatctgcccatctcagcctcccaaatgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctggtgaggaccccggacttgttcttcctcctgctcctcttcccgcctcctccctgcaatccctctcctctccggctcctcccctcc

SEQ ID NO: 406206 - DNA, 12046 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaaaaaaaaaaaaaaaaaaaaaaaaaaagggggcgcgccccccctccttagcctcttactatactataattatatttattctcacattttggagctctccccacaactctcaaggggggtacattagaaaaatctcccccccttatacggagggtggcggggttgtcggacccccatatatattcccccgcggcgccggcggtcccctttttcgtccccaataaaaaatgtttcctgtctattaagagaaagggcataagtagaacaccttattctaatatatagttgcgcggagctgcatacagaaagcttgggcgccgtcctattatatatcacccaattatcaattgggagggcccctataaaaaaagagcagatgttaaaccccgtgggcgcagcttataatagagcgtcttattggtagccactacccttccctgaatatgaagctccccatccaataccccataaagaccccaaaaaatgttcggggggccctatatgagagggtgggagctcacccaacacagcgggtgtttacagaccgggaaccacgagacattaagacgaaacgcaacaacacaaagaggggggggggggcgctcccaaaacaaaagtttaccccccggggaggcggcccaacactcatgcacgggagtaccca

SEQ ID NO: 406207 - DNA, 12119 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtgggtgagagtcccaggggaaggtggacatcagggagggtggtggtggacgctgatggaccgtgccccgcaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaaaaaaaaaaaaaaaaaaaaaaaaaaagggggcgcgccccccctccttagcctcttactatactataattatatttattctcacattttggagctctccccacaactctcaaggggggtacattagaaaaatctcccccccttatacggagggtggcggggttgtcggacccccatatatattcccccgcggcgccggcggtcccctttttcgtccccaataaaaaatgtttcctgtctattaagagaaagggcataagtagaacaccttattctaatatatagttgcgcggagctgcatacagaaagcttgggcgccgtcctattatatatcacccaattatcaattgggagggcccctataaaaaaagagcagatgttaaaccccgtgggcgcagcttataatagagcgtcttattggtagccactacccttccctgaatatgaagctccccatccaataccccataaagaccccaaaaaatgttcggggggccctatatgagagggtgggagctcacccaacacagcgggtgtttacagaccgggaaccacgagacattaagacgaaacgcaacaacacaaagaggggggggggggcgctcccaaaacaaaagtttaccccccggggaggcggcccaacactcatgcacgggagtaccca

SEQ ID NO: 406208 - DNA, 10875 bp, Homo sapiens
gagaacgcaggtctccatcctgacctgcaggcaagggggactctactgacccctgaggtgccctgtcctaggccccacccggtcagtgcacacctgctccccagtcccgcctccacaaaggccctgtgagaccctgtcctccaccgcctctttccttgtgtccattccctgagcctggggaagttgcgtcagagccacaggctcggggacgctgagtctgggcgagcgcttgctgccggacagctggagaaacagcagcggggggccgtgtccatgtggcaagccaagccatcgaggggatcacaggccccttcagggaagggactgagcacctgccacctgcctccaggatgggcctgatcccccctcctgtgtaccccacaggctgcagtgcacctgccagcacaacacctgcgggggcacctgcgaccgctgctgccccggttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttta

SEQ ID NO: 406209 - DNA, 6054 bp, Homo sapiens
cctagaaggagtggaaagagtaggccctggtccacatggagtgggtggtcaccagccccaaggcctggtcattcccgagacaggacatccgtgtggctttgagagctatgtcctcaaacagcagccaggtgctggcccacctccagccggccgaggccaggagttcctgaccagcctctgacccagcggtgaccatgctccacgggttcccagtgcctcgtgcctgcaggatccctgagggtctgacttgtgagcttgcagggtggggcccctcgtcctctcaatcgctgatgccacctgcccccgtacaccctcaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttta

SEQ ID NO: 406210 - DNA, 10943 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttta

SEQ ID NO: 406211 - DNA, 2821 bp, Homo sapiens
gccgcgggttcttttggtatcttgcctcagtccgtcctgctgtagtctgaagtccccttggtccatcctggaggggaggcgcctcaggccaggtgccctgacccagccctgtgcccacagccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 406212 - DNA, 8639 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccgagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagactcgcaacactgtgtcccgcgaggagctcatgatggtgctggccagcctggagcagctgcagatccgtgccctcttctcacagatctcctcggctgtctccctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcatgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggtgggaggcccaggagagaggccggatgcctccaactgcagggcccttgcccgttcgccatctctcccctctccgtgtgcacccaccacccttcacctctccatgcccac

SEQ ID NO: 406213 - DNA, 3976 bp, Homo sapiens
ggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccgccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgagcaggcacgcttcttcctggtaaggacccctcaggtccccaccccaaggggtcagcttctttcagaagatttgaaacatgcatgagaggggagaggacagttggggtcccaggtccccaaggcggccacactcgctcatgcccagcccagcatgtttcttctggaacccctcctgcaagcgttttgtggattcagtcccttttgacgtacccccgagctgttccatgtgctcaggaaagcacctgcagtcacagctccctggccccagggcagccacctcctggcacagacagcgttggttgcctgttctggaactttcttttcttgttctgagagcctctctctataaaaaagaaagagatgaagagcaggatatcataacagagcctgcagtcagcccgtgtactgccagtgttgg

SEQ ID NO: 406214 - DNA, 271 bp, Homo sapiens
gctccatgggggtccgtgagggtgcccaggccctgtcccggtagggaatgagcgcaagtatccaggcccagcacagggctctgtgctgggggtgcccagaccactgctgacgggctctgagcctgtggccagagtctggccaggtcacctctgtctgtcctgcctccaggtgtcatcctacggtgggaccctccgttatgaactgcactcagagacccagcggggagatgtctttgtccccatggagagcaggccggatgtggtgctgcag

SEQ ID NO: 406215 - DNA, 837 bp, Homo sapiens
gctcagaagctggctgagcagactggtgtcagggtgttggaggcactgcaggaggtgagggccgggcaggtgaggcagctgtggcctttcgccaggtgctctaggggccacccaggtgcgctcaggttccgggcccctggcctgccaaggatggcagggctggggtcttgggcttggaagccagcaggcagaggtgcactagtacgggcggccccaggctctgacgaacccctgccccacagagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagatgtgagtggtgttgtccctggcaggcggggtggggagaggcagggacctgggagctccaagggggaggtcagcatggagtggcatcaggtgggcatcacggggcagatggatctggcgggcaccaagtggagaccaggggtcatgaaggggcctggcttccagagtgaccaccctcaccctggtctcggctagtgctgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctggtgaggaccccggacttgttcttcctcctgct

SEQ ID NO: 406216 - DNA, 247 bp, Homo sapiens
gtgctgggattaccggcgtgagccaccgcacccagcctaacatccccacctctttgaccatttcttcccttgtaacaggcctgaggacctgaggtcccttttttcctcagaagatagttgctaccattcactttataaccaggactctttcttaagcctgggaggacagtgggatgtatcctgccaggccctttcctctccttttgttcattgtagacaagagacagagaatgataataaggatata

SEQ ID NO: 406217 - DNA, 170 bp, Homo sapiens
taatattgatactatcactgcccataataagagaacaatggcttaaaaagttaaatgacttttccaagggcacacacatcagatttgtctgcctataaaatctctgcttctggcattgtttctctgaggccaatgattttcctttgtctcttgggtgtctctaggctgca

SEQ ID NO: 406218 - DNA, 528 bp, Homo sapiens
caagccagtgagttttgcagtatgcctgagatttggtgtgctggcttagacaaaaactcaaaggatttttttttccctttcacttcttggttgtcagctgagttcaagttgttggagatcatgactttccaggtaagtcgggtgttaccgaagaatgggactgataaaagatattttctgaggctgttatttgtattgtaggttgtcttaccatcagcgtatattagatattgttcctcctaccttctcagctctgtgtcctgcaaacccaacctgcatttacaagtatggagatgaaagtagcagtaagtaatgaaactaatccctctgtctttaaaaggtaccagttcaagtatatctgaagttagttgtttaaagtggagaaattgaactttttcttttcttggggtttatatttcctgtatttgaaaggtggtcgacgcggccgcgaatttagtagtagtagggggccccctaaaaggatccaggcttacgtaggggtgcatggcaaggccatagtccttctaa

SEQ ID NO: 406219 - DNA, 614 bp, Homo sapiens
ctggtaagggatggaaataagaaaaatgactacacagtgctgccctcagggggctcgcctgaatctaatgggtgtgaagatagatacttgcacaatttacaataaaagaccaatttgtaagtattgctggagaaagatgactaattcagccccaaggacagaaggctgtatcagctgttaagaatgaaattacaaaagttgaaagattttattttctgtaaccatagcttgacatacagtaaccaaatgccatatttctttaagattgtttgtttgggaaattttgcactctacaattcgtaagatgaacaaacatgtcctgaagatccagaaagagctggaagaagctaaagagaaacttgctaggcaacacaaacgggtaagttttgtgtaaacttgtaagtagttaaagaaaatataccagaaactctggagaggattcagagttcattatcttgatgatatttcattttttctgagcccaaattaatgcagagcagaaatttttctgagcccaatttaatgcagaagcagaagaggaggaaggagcaggtagtgtgttgtgtgctgttacactgcatgatgaaccagttcaggaagccacaaacttcact

SEQ ID NO: 406220 - DNA, 6270 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406221 - DNA, 5537 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgt

SEQ ID NO: 406222 - DNA, 5540 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatactgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406223 - DNA, 6299 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagtgtatgtatgcaaaagatttatgaatccagtgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406224 - DNA, 5991 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagtgtccgttttttatctgatcttgtgaattgtcatgtgattgccgccccatcaatggttgctatgtttgaaaattttgtaagcgtaactcaggaagaagatgtacctcagaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406225 - DNA, 4096 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttcttccacccctgagatggcaagaccagccccttgtcttcctcagcctgctcaacgtgaagatgatgaggatgaagacctttatgatgatccacttctacttattaaatactgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406226 - DNA, 3362 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggattacctgagcctgggagttcaagaccagcctgggcaacacagtgaaaccccaatctcttaaaataaataaataaaaaattaaaaaaatt

SEQ ID NO: 406227 - DNA, 3130 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacaggtatgtggggaacttcgattaggtaataacactattctcagccacaaagatttttcattaaaaaaaatccttgtcaaatttgttaggaggttatatagtacctgttagaccctttagttcatgtccatttgctgctaccattgctcatcagaatatttaggcttaaactgattctgtaccacttagattcctaattgccacccccccaacaaccccccgcc

SEQ ID NO: 406228 - DNA, 4601 bp, Homo sapiens
ctggtaagggatggaaataagaaaaatgactacacagtgctgccctcagggggctcgcctgaatctaatgggtgtgaagatagatacttgcacaatttacaataaaagaccaatttgtaagtattgctggagaaagatgactaattcagccccaaggacagaaggctgtatcagctgttaagaatgaaattacaaaagttgaaagattttattttctgtaaccatagcttgacatacagtaaccaaatgccatatttctttaagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcaggtatcttggcttgggacatttatacataaaaggaaacaatacatttctttagttttagtttttaaaaatgttatttttcattgtaaaaggaatacacattcatttatagaagagattaaaaatacaaaaatttaggaaggaaataaaagttcactactcagaggcaaccatgtatgtctgagtttctctgctgtttacttagtattctcgcatgagcatttctccatgcttgaaaaaaaattgtgggttgctttttttatatatgtctcgtttaattattcctcattgctgatcattttccttccatgaacattttaatgcatagattcctgttaaaatttctgattacttcgttagaatagattccaggaagtaatattactaggataagtaatttaagacattaaaggtctttatgtattgccaggaagaatgtaccaactcatgttattaccagtctgcccttctaggttgacttcatgaataatggaagctaggcacacacaccacaaagacagggtggaacaggcaatactttggggtttctttgtcatgaatttttttccaaagtataagattctgtctgtagtactaccttaacttcttctccctttccagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406229 - DNA, 4560 bp, Homo sapiens
atgaatgattagcaagctgtctccctgttgttactgctcaaatggtcaaatagtgataaattgtagccaagtccccccatgttgttaccaagacaagtgccactaaatttccctggcctagataagaacccatggaatttctgaatgagaagacagtgtctctgaaccacaacaggactttgaggtatatatgtgtgggtggcggggtgggggggtactttcactatagaatataagtcttaacatttggccagacacagtaaaatgcttcccctggaggagatttaacacactggaatctaaatggtattttccttttgttcatttgccttctatagcgaagtgatgatgacgacagaagcagtgacaggaaagacggggttcttgaggaacaaatagaacgacttcaggaaaaagtggaatctgctcagagtgaacaaaagaatcttttcctcgttatatttcaggtatcttggcttgggacatttatacataaaaggaaacaatacatttctttagttttagtttttaaaaatgttatttttcattgtaaaaggaatacacattcatttatagaagagattaaaaatacaaaaatttaggaaggaaataaaagttcactactcagaggcaaccatgtatgtctgagtttctctgctgtttacttagtattctcgcatgagcatttctccatgcttgaaaaaaaattgtgggttgctttttttatatatgtctcgtttaattattcctcattgctgatcattttccttccatgaacattttaatgcatagattcctgttaaaatttctgattacttcgttagaatagattccaggaagtaatattactaggataagtaatttaagacattaaaggtctttatgtattgccaggaagaatgtaccaactcatgttattaccagtctgcccttctaggttgacttcatgaataatggaagctaggcacacacaccacaaagacagggtggaacaggcaatactttggggtttctttgtcatgaatttttttccaaagtataagattctgtctgtagtactaccttaacttcttctccctttccagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406230 - DNA, 3533 bp, Homo sapiens
ttttttttttaatgttggggattttcaggggtccattattcctatcagcacttttttttccccttcctctttacatcattctgcagcatgggtgggctgctgaaggaaatgttccacaagattgcttatatgctttttcctgacctaactacccccttttgtgtgtccacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406231 - DNA, 1964 bp, Homo sapiens
cggacgcgtgggataacatacaaaatgagtttatcagctgttgttatggtaagtcagcaggggctatggtggttaagtttgggggagtccaaaagttacatgcaaattttttactgtgcggggtgtcagcatccctaacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406232 - DNA, 460 bp, Homo sapiens
cgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgagtgcctgcggcccggccacggaggccgctcccggttgggagccgaggct

SEQ ID NO: 406233 - DNA, 479 bp, Homo sapiens
tttggtattaatataatagaggctatgaataaggaaacctgtgtgatttttttttttcaaggaatggatgatagaattaagacagtcacataaaactaagacttaaaattacaagtggtttcatattttcagtgtttgaaatcagtgacggtcttttattgtttattagaaccaaaaaacattacacaaatatctgtgtatagatgtgagcaaccatctatttagcatttgaggtaaggcaccaaggaattgctgtgcttacatttttctgttttactataaaatatttttcagatgaaggattcagttttaacccattgaaaatagaagtctttgtacagactctgctacacttggcagccaaatcattcagccactccttcagtgctcttgcaaagtatgtatgagtacagagccttgcttgagagtttggaattttgcttggtgaacaccagtggtatggtaatttttacctaaga

SEQ ID NO: 406234 - DNA, 860 bp, Homo sapiens
aaaatttttttttttcttgcttcagtttcatcatcttttatatggagaaaataatatgtaccttggaagttgtgagaattaaataataaacatgttaggtgcccgcacaaaacaggtactagaattatatctgtcattgacctaaaaaggataaagagagttggcagaagatacaactgcatgtaggggaatatgcttttcattaactctgtaaagtcgggttttatctgtttgaaggcttatataagtttctgttctaaatcccagttattcttcctttttctctgcctacctcccccttctctacgtaggtttattaattggttttctcatcatctaagtaacttccagttccgttggagctgggaagattggtaagtgatggtttgttttatctttttctgtagtcaaaaaactactaatgtttaaaactgtaacataaaagtgtctgaaatatttaatttcttggaaactatttgtagttaagtacaaatagttacaagtgcaattataacttaacaaaacttgtaagttgttataagttaacagataattatagtacaaatgggtgtaagtgcagattatatgtaagcattgataaaactacatttcctccttaggtcagattgtcttagtcaagatcctgaaagtcccaaaccgaagtttgtaagagaagttctagaaaaatgtatgaggtaagttttttgtgttttctccttttaacttctttgggaggatttctttctcttctctgcacttgtgatgtgtgttcagaatattggattcaaaatccacttactcatcttccatcccatttttaatcaagacttaggctaagaaaaattaggcaaccatgccat

SEQ ID NO: 406235 - DNA, 3450 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtt

SEQ ID NO: 406236 - DNA, 5504 bp, Homo sapiens
  misc_feature (5407)..(5407): n is a, c, g, or t
  misc_feature (5427)..(5427): n is a, c, g, or t
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaattctaggtcttaggtnatgtctagaagatttttatntcggaatattaatttctatcttcgtacgtcacatacagtctcggacacggggatgcctccagtagtcgaactgcagc

SEQ ID NO: 406237 - DNA, 6888 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcaggtatcttggcttgggacatttatacataaaaggaaacaatacatttctttagttttagtttttaaaaatgttatttttcattgtaaaaggaatacacattcatttatagaagagattaaaaatacaaaaatttaggaaggaaataaaagttcactactcagaggcaaccatgtatgtctgagtttctctgctgtttacttagtattctcgcatgagcatttctccatgcttgaaaaaaaattgtgggttgctttttttatatatgtctcgtttaattattcctcattgctgatcattttccttccatgaacattttaatgcatagattcctgttaaaatttctgattacttcgttagaatagattccaggaagtaatattactaggataagtaatttaagacattaaaggtctttatgtattgccaggaagaatgtaccaactcatgttattaccagtctgcccttctaggttgacttcatgaataatggaagctaggcacacacaccacaaagacagggtggaacaggcaatactttggggtttctttgtcatgaatttttttccaaagtataagattctgtctgtagtactaccttaacttcttctccctttccagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406238 - DNA, 4826 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcccttaactagacaaatctattttctgtaacatagtggccttggtaatacatgctcattaactagtggttattatgtgccaggtgctataggttcaccctattaactacttcaaacagtcctttgagatgattatgccctctttacagataaaaacaggttttggagtaatttacccacggtccacagctagtaagtggaatttgaacctagatccagttggcccaagagctccttccccgcccccataatgctcttacaacaacctgaacccctagttattctgttgtcatcatctgttgtcatcaagctgaaagcttttttccccagagacatcttgctgcccattcagaatcaatttttactaagctgtaatatttagcatagcacgtattagtcattgagtgtgaaggtgtttaaaaaaaaatcaaacttgaaaaatacacaaacatttctgtgtagtctgaattatttggacatgacttgttttgacttagcctttctccaagcataatctccattaaagaaaaaaaaatggaaatgttaaa

SEQ ID NO: 406239 - DNA, 3363 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttcttccacccctgagatggcaagaccagccccttgtcttcctcagcctgctcaacgtgaagatgatgaggatgaagacctttatgatgatccacttctacttattaaatactgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgt

SEQ ID NO: 406240 - DNA, 3748 bp, Homo sapiens
ggagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcaggtatcttggcttgggacatttatacataaaaggaaacaatacatttctttagttttagtttttaaaaatgttatttttcattgtaaaaggaatacacattcatttatagaagagattaaaaatacaaaaatttaggaaggaaataaaagttcactactcagaggcaaccatgtatgtctgagtttctctgctgtttacttagtattctcgcatgagcatttctccatgcttgaaaaaaaattgtgggttgctttttttatatatgtctcgtttaattattcctcattgctgatcattttccttccatgaacattttaatgcatagattcctgttaaaatttctgattacttcgttagaatagattccaggaagtaatattactaggataagtaatttaagacattaaaggtctttatgtattgccaggaagaatgtaccaactcatgttattaccagtctgcccttctaggttgacttcatgaataatggaagctaggcacacacaccacaaagacagggtggaacaggcaatactttggggtttctttgtcatgaatttttttccaaagtataagattctgtctgtagtactaccttaacttcttctccctttccagcggtttatcatgatcttgaccgagcacctagtacgatgcgaaactgatgggaccagtgtattaacaccatggtataagaactgtatagagaggctgcagcagatcttcctacaggtatgtggggaacttcgattaggtaataacactattctcagccacaaagatttttcattaaaaaaaatccttgtcaaatttgttaggaggttatatagtacctgttagaccctttagttcatgtccatttgctgctaccattgctcatcagaatatttaggcttaaactgattctgtaccacttagattcctaattgccacccccccaacaaccccccgcc

SEQ ID NO: 406241 - DNA, 181 bp, Homo sapiens
agtgcccagtgggaaatattggagagatactttggaataataggcgactattactttgaagtcagacctgaagtccattatctacttgaccaattagtaggacaacaatctcactgaacccgttttctcatatggaaataagataaaacttgaagagtgaacatcgcggtaggtgctttgt

SEQ ID NO: 406242 - DNA, 439 bp, Homo sapiens
aataaacataaaagatctctctcctttccaggacaccctcaatggtttgtttcaccaaatgtccaatctatatttaataagcctcaacagtcatttttctgaaggcattggccaggtcctccttgtggcagactttgaagagctattgcaaggtctaaacttgtgacatggaagaaaatacaactaaaaattaaatgatcttagaataaagaaggccttattaatttctagtgtcagaaattatcaaggaagagaatgtacttagctatgtaacacctcagaacttctttcaatcaaaagacattctgaactattctgaaagataaaagacaagctggggcagtatttacccatgtatgagaaagagttattaagagttcttacaaattaatatagatttataacataaagataattacactaatagaaaatgggccaa

SEQ ID NO: 406243 - DNA, 326 bp, Homo sapiens
taatagttaacgtgcctacttgctattgtattgaacagtacagcagaaagtaagattaatcctaagggggactttggttttcaggattacttatattttataataagactgtattacatatatacatgcctacatttatgtatgtatatatgtgtattttttatctatagaggttgccttgtctcataattatgtctacttgtcttctccatactccaaatgtaacagttcattgaaagtacatatgaaaaccattaataattcaagtaatagtcttttcctctcaacttactcaagatatacatatatatatatacacacacaca

SEQ ID NO: 406244 - DNA, 438 bp, Homo sapiens
aaagaggaaccaatgtctctatgtgtaagctggacaaagctttgctattaagtcagagaaaaatacatgcttaccttatttatatatttgttcatattgatatctttcaattgtgttagtccttctgggaatgtaatatggaacaagaaacatacaccctgatgaacagagttgcaacaattgcttaaaaatactagcaaaccaggctggggtgcggtggctcatgcctgtaatcccagcactttgggaggacgaggtgggcagatctcttgagttcaggagttcgagactagactgaccaacatggtgaaaccccatctctactaaaaatacaaaaattggctggacgtggtggcacatgcctgtaatcccatctactcaggaggctgaggcaggagaattgcttgaacctgggaggcagaggttgcagtgagccga

SEQ ID NO: 406245 - DNA, 560 bp, Homo sapiens
actgaggcctcgggtagttcaacttagagatcagggacaagaggtgggacaaaggaggctacacaggaacagatactatggtaggtagaaaacaaagtggtttcctcaaagcagagaaggagggcgtagcaactgtccaatgctagtgtagtcaaacgagcaagtaaggtaaggcctaagaactcaccacggggcctggtgtggtggctcacacctgtaatctcagcattgtgggaggccgaggtgggcagatcacctgcggtcaggagttcgaggccagcctgggcaacatggtgaaaccctgtctctactaaaaatacaaaaaacatttagcctgtaatcccagcttctcgggaggctgaggcaggagaattgcttgaacccaggaggtagaggttgcagtgagccaagatcacaccactgcactccagcctgggcaacagagtgagaatctgtctcaaaaaacaaacaaacaaacctgacaactgaagttagcaattcacacttacatggtaagctgttggtgaccttgacaatagctatgaaggtaatggtatgga

SEQ ID NO: 406246 - DNA, 186 bp, Homo sapiens
ttgtattctatagtatggatatatggtaaattgtatacatgtaacttaatcgttaaagtcagctctgtcaatgatagacatttagtgtttttccttccatattttcactattacaaacaagtatttttatgtaacatctgattatttccttaggatggattcttacaagtggaactgctaggtcag

SEQ ID NO: 406247 - DNA, 247 bp, Homo sapiens
tctgctagttgtcagcctccctttggataagcacccatcagcatttgatcaggcttctgctcaatgtccttcaagtggctctggccttgccttgagagcagggtaaagataatctcttgtttgttgataaggaaaactcaggctcagcaaggttaattaatctgtacattatgcaactggaatttaaatctagtttaactcattccactgtggcataaaaggaggtacacgtacctatctgtgatga

SEQ ID NO: 406248 - DNA, 476 bp, Homo sapiens
caggaccttcaaagcggttttatgccaccatgcctgcttatgaccttcctccaatacgcatgccctgttttgccagccaagccagcacctcacctcaggctcagctcatccatgaagtcttgactgactcaagtccccatccccaagaagaattggccctgtcctcctctgctcccattccatgcctcgtagagactctgaacctggccgcagttcaagggcaggagagcctggctgtggaggatgcagggttctggaaaggcaccaaaaagtcatagcaaatgatgtgggacaggggaggctgatcagggcttagcttgcaaataaaatttaaaattgtgaaacagattgggcatggtggcttacacctgtaatccccacaatttgggaggccgagtcggggggatcatttgaggtcagcagtttgagagcagcttgaccaacatggtgaaaccccatctctactaaaactgcca

SEQ ID NO: 406249 - DNA, 1559 bp, Homo sapiens
  misc_feature (1)..(1): n is a, c, g, or t
ngagagggcagagcatgtttgggacataacaaaggatctgagtagtaaacaccgtacgccacccaactcctcttgtaacgccatcgcgcgtggcattgtgttgggttctgcgtgtgtggcatcggagtcgtggaatttagggggaacaaggcttttccccccgtccccccggggtctcccttgggtgggggcgacacggccaagggcggcgcgccctgggggtgcccgggggcgcttcttccccagggcgttacgcaccggcggcccggcgcggaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaacttgctgtctgcttggaaaatttcactcacaagccgcagctttgcctgactcagtgcaatccaaggccatcatctctggtgaacttcccttgactcctccctccagccacttgcagaaatgcaaatcctgggcacccacaggctgtttgggggcctgtatagaagctgtgggcagaaaccagaggccactgtggtactgctggactcctgcagccaaaggacaaaagggcgagactacgggccgtctgggcaaacagagagaagccactttattccctgtggagtggaggatgctaggatgttgctgctccggcagacagaggcctttcgcttgagtcatcagccaacagactgaatgttatggttttagaaacccatacacaaagttgagtggttttttccatttctaaaatttaaaatgtatgtatttttaaaacacccacctgcatgtaatacacagcttgttcaggagttctcaaacagccccagcacccaccccatcccagaggctcaaccaaataaaaccaaaaccaggaggctgggtccttttaagcactggtaatttctacctgtaattccagccctttgggaggccgaggcaggcaggtcacctgaggtcaggagttcgagaccagcctggtcaacatggtgaaaccccgtctctactaaaaatacaaaaaaaattagccaagcttggtggtgcgtgcctgtaatctcagctactctggaggctgaggcaggagaatcacttgaacctgggaggcagaggctgcagtgagctgagattgtgccactgcactccggcctgggtgaaagagtgagactctgtctc

SEQ ID NO: 406250 - DNA, 6663 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406251 - DNA, 7200 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggtaatcccggggggggcccacactagaggacaactccaccggatgtttttgatgtaaaaggggtggtgcccacataatatgggggggtgtttatattatataatacatacagggcggaggcgcgtcgttttcataactacagccgtcgtgttggatggaaacaaaaaactacgtgatagtgactgattttgatttgtgaaaaacgagacaccccctatatgttgtggggggcggacgaaaacatttagtgggagaacaacctttatactgctagcagtagattttacagcagcctcgtcagcgaggattaacattaaatctttgaaggttgtaagtggtgggtcgcaacacacaccgtgaatatttattgtctggtctgatgaaaagaggtgctgcccatgctgatgattttatagaaaaaatattctcacggg

SEQ ID NO: 406252 - DNA, 6612 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406253 - DNA, 6382 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagcatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406254 - DNA, 4319 bp, Homo sapiens
ccttccaccagggcactggggagacattcttctctggcatttagggaacagcaattttcacatttgtctgctctccgaggtggacagaagaggctgattagagcctgaagccatttggtagcctcattcataattgcttactatgggaaccactggcagacttggctttcatgcctgggaaggatgagaccaaagcctgacccgaaagccagcgatcgccaagatgagttaaatgaataagcaaaggaagccacttctttctctgctctccactcaggccttgccagccatttaaatagtaccactgtggctgttctctgaacccatttcatttgccttcctttgggttattgttttccccttttagacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406255 - DNA, 4178 bp, Homo sapiens
taatgatgaataagatgtgggtctggcctctcagaatctagagggagaagaagggcacgcacacaaccagccaagacataaggcagctgtgccgggtgctccatgtgaaagagatggaaaggaaatgataccgagaaataggcaggagggaccgatttgacttagagactcttaagaaaacacagcatttgaatcaaggctctgaaggagccttaagaaagggtcacagagcctggagaacaaggacatgaataaaccaaagacaccgaaactcagtcccaactttcccttggagaggccacagcagcacactggtgtctttcccgagtgtttatggagaacctctgtttgggtttgtttctgccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406256 - DNA, 2598 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagaaattactt

SEQ ID NO: 406257 - DNA, 784 bp, Homo sapiens
  misc_feature (11)..(11): n is a, c, g, or t
gactttagagnatccccacgttgacactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406258 - DNA, 1212 bp, Homo sapiens
  misc_feature (1114)..(1114): n is a, c, g, or t
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtaagcaccgtcctgtcccactgtgtatcccatccatgagatgcacacgccctancctgggttaggtctacctgggcaggtagaccagagccgggatgtaggtatggaggattggagttgcggtgtagagatgatggaggcggtcgggaaaat

SEQ ID NO: 406259 - DNA, 341 bp, Homo sapiens
ggtgggtagggggagggatgagccggaataatctcttccaccgaatgagtaagtaggttagtcttctggactgccataaaaggtctgtaaaatagttttaatcagacactggtacagaagagaaggagggagtgtggggggaagaaagttgtaacatatttgaagttctttgggtcgttgatttctctttcagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccc

SEQ ID NO: 406260 - DNA, 309 bp, Homo sapiens
ttacccccaggactacccctcccaccagaactgcgagtggattgtttacgcccccgaacccaaccagaagattgtcctcaacttcaaccctcactttgaaatcgagaagcacgactgcaagtaagcaccgtcctgtcccactgtgtatcccatccatgagatgcacacgccctgcccccacccctgctcttgtcacttctatcacccctcaccccaagacctgctgctaaccagtggtggatcctggccccagaggaaaacctcaaggggcattccctttccagggaaataaaggtgtggctgatccca

SEQ ID NO: 406261 - DNA, 332 bp, Homo sapiens
gggcaaacactgtgggaacatcgccccgcccaccatcatctcctcgggctccatgctctacatcaagttcacctccgactacgcccggcagggggcaggcttctctctgcgctacgagatcttcaagacaggtcagtgtggtcacacgtaggggccgggagatgggcgtcttagagaagaaggagggacagcacccagtgggctgaggcactgggtaagggtgacagtgtcatccagcttgagcatggtgagaggttcaaggtgaacccacaaacatcatgagaagaagagccagctcagattatccaccagcttaagggggcgggctgtgg

SEQ ID NO: 406262 - DNA, 447 bp, Homo sapiens
ctccatgacttgatgtagttgtttttaaaatgtgagcatataatatagggtcttttaaatgaggaagtgcctgcaaggacttgtccctagaagggaggcagcatttgggggatcccgaggtatgaggttggaaggcctaactgcatttgaccgtctgctttccccagactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtacttgtgcagataccagaggatgtgagagtgtgtatgtattgctggggtaggagggtagctcctcaaatatagtaggcagaggacacaaagaaaataaacacagcata

SEQ ID NO: 406263 - DNA, 696 bp, Homo sapiens
tgccacaaagatcagagagaaccaagaaagtgttgattgacacagggccattgtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagaaattactt

SEQ ID NO: 406264 - DNA, 6478 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406265 - DNA, 6481 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggacctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406266 - DNA, 5041 bp, Homo sapiens
tccatgcccagattgctaatgaacagatcagtgcctcatccacctcccatcagagtaggtagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgattttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcgtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 406267 - DNA, 4840 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggtttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatctagctctggctgggtttctgttggctgtcattgtcatctccaggtacctaaagaaatagaggccacatgggatgcagtgtggcttctcccatccctatccccaacccacctgacccaagagaaggttcccctagcacactcaaacaagacccccttgtcttctggtgtctttgaaatgtcaagataacagccactgggtgtctgcggaaccacctctccagccctaaagcaaatctgtctcatgttgccttataaaagagaagctcataatgaatgtttagcctttatcagttacatccaatcttggaataagtcatagagaataacaagtctgggactgacgtaggaaaaacagtagtctgtttaagttgagaggaggaggaggtggacgagagaagggaggagagggaagaactgaaatgtctcctcacccagggtggttattgggcccaacttgggatggggttgagtacgaaggttaaaaaacatatactttggtattatattggtcattgtaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattc

SEQ ID NO: 406268 - DNA, 3572 bp, Homo sapiens
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagattttaaaggtaaaaaaaaattttttttttgcatgctttttccttcccccatgtgatgtgaatttgatggggggaatcaacctccaaatttgtcaaatctcgcaagagaaaagagacgccacaccttcctgccgctagatggcactagcaacacctgtagatgcgggaaggggattgagagcctcactgtctcttgtttaattaaagtttagaaacctattaatagagacaaataggttacagataaacctttcagccttgcattgtccaacggggagcaatgaggctgaaaatgcaggggtggtgagaaaggagagactgtgggaagactgaaccaaa

SEQ ID NO: 406269 - DNA, 1027 bp, Homo sapiens
  misc_feature (929)..(929): n is a, c, g, or t
gggagccggaggggaggcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgcgtgtccgtcaagggtgccgcgggatgtgtgtcagtttacgcctctgagatcacacagctgcctgggggccgtgtgatgcccaaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtaagcaccgtcctgtcccactgtgtatcccatccatgagatgcacacgccctancctgggttaggtctacctgggcaggtagaccagagccgggatgtaggtatggaggattggagttgcggtgtagagatgatggaggcggtcgggaaaat

SEQ ID NO: 406270 - DNA, 411 bp, Homo sapiens
gcctaagtggaacgctccgctttgacagatgtgctgctgggttgggaacaaatattttttaatactcaccttcgcagaacctgtcataacacatacattgagaaactaggatagaagaaagcaatttatcatacttgattatggcctggtggcatatcacctaagattaattgattcccttctactataattttatactcataaagaattgaaataatttcttttaacactttaatagtggttagggcccacccttgatagagtgcactggtagtacgtgctttaaaggaatgaatttgaattatagttacaagtctgtttcctccgaaatcagtttctagtaaatggatttattggtatctgatcaactgaattgataacatgcaatttctgagcagaattctattgtgg

SEQ ID NO: 406271 - DNA, 2185 bp, Homo sapiens
tgctggagataaatggtcgaccccggagggagaggctagtaggggtgttgatgtgaactgattcgcccaagccttgggccgcaaaactgcgaaagaaagcggcaggcagcctctgcatttcccagaagtgcagctggggaactttcccagaccggcccaggggttgctagagggtcagacgtaaaggatccgcctttcctaggcggggtgggccccaggccaccacgtgaagcgtcctcgcccctcagagcccggagcaggccgggctcaagaaagaggaaagttgaggacgccccacctcggagaggcggcgcccctgagtaggccaggagcctctcttgcaacttctgccaccgcgggccaccgcggccgcctgatcccgcagaggaaggtcgcggccgtggagcgatgacccgcggcggtccgggcgggcgcccggggctgccacagccgccgccgcttctgctgctgctgctgctgccgctgttgttagtcaccgcggagccgccgaaacctgcaggagtctactatgcaactgcatactggatgcctgctgaaaagacagtacaagtcaaaaatgtaatggacaagaatggggacgcctatggcttttacaataactctgtgaaaaccacaggctggggcatcctggagatcagagctggctatggctctcaaaccctgagcaatgagatcatcatgtttgtggctggctttttggagggttacctcactgccccacacatgaatgaccactacacaaacctctacccacagctgatcacgaaaccttccatcatggataaagtgcaggattttatggagaagcaagataagtggacccggaaaaatatcaaagaatacaagactgattcattttggagacatacaggctatgtgatggcacaaatagatggcctctatgtaggagcaaagaagagggctatattagaagggacaaagccaatgaccctgttccagattcagttcctgaatagtgttggagatctattggatctgattccctcactctctcccacaaaaaacggcagcctaaaggtttttaagagatgggacatgggacattgctccgctcttatcaaggttcttcctggatttgagaacatcctttttgctcactcaagctggtacacgtatgcagccatgctcaggatatataaacactgggacttcaacatcatagataaagataccagcagtagtcgcctctctttcagcagttacccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatggcagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttccca

SEQ ID NO: 406272 - DNA, 513 bp, Homo sapiens
tggtttttaattttaatttttatttttcttcagaggttgcaatgagctgagattgtgccactgtactccagtctgggcaacaagagcgaaactccgactcaaaaaaaaagctaatattgtgactttggtagtgggagagtggggaaggccatggatttaattttttgctgaacgatgattttctaaaatgtcctcctcctccctctttccaggtggcagatatctacctagcatctcagtacacatcctatgccataagtggtcccacagtacaaggtggcctccctgtttttcgctgggaccgtttcaacaaaactctacatcagggcatggcagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttccca

SEQ ID NO: 406273 - DNA, 468 bp, Homo sapiens
tgggactacaggcgcccgccaccacgcccaactaatttttgtattttcagtagagacagggttttgctgtgttggccaggctggtctcaaacccctcacctcgggagatccacccgcgttggcctcccaaagtgctgggattacaggcgtgagccaccatgcacagcctgcaagggaataatttaatgggtccctaacaagaggaaaacaggaaatgatgtctgtcacaaaacgatgttaagtgcagtctttgtcctttcctagccaatgaccctgttccagattcagttcctgaatagtgttggagatctattggatctgattccctcactctctcccacaaaaaacggcagcctaaaggtttttaagagatgggacatgggacattgctccgctcttatcaaggtaagacatagcagctccttttgccttgttctggttcatacagactttttctatatagcgccc

SEQ ID NO: 406274 - DNA, 396 bp, Homo sapiens
gggggaaaggcagaaattaagcaataaagtcattttccctggagggacatgagagggaagaaaggccatgaggcatcagagcaggggacagtgtcccacagcctggagtccagccccactctctacctgctgggtgcaagggcaaagcactgcacccagaaactcggtttcctcatgtgcaaaatgaggaaaatacatctatctcatagggttgtaatgacaatacctgcaaagcacctgtctcaataaactggctgttttaaaaagtgatgcttggccgggcgcgctggctcacccctgtaataccatctgctgccgtgaggacctgaactcacctaacccaagtcctggaggttgttatgacacaaaggtaacatgctattggcttttgaattt

SEQ ID NO: 406275 - DNA, 1403 bp, Homo sapiens
cagggtttcaccattttggccaggcttgtctcaaactcctgacctcaagtgatccgcctgccttggcctcccaaagtgctaggatttcgagcgtaagccaccatgcccagctggagtcttccattttgaatgttagaaggaagagtctgtttggggccacattaaaggttaatcttgactccttggccatattttccaataatcagtatagcaataaacacttacctgaaatggcacaatccctgtatgcctcttacacttaagacaattgcagtcagttagctatgtacatctgtgtaatccactatgattctggctgtaggttcttcctggatttgagaacatcctttttgctcactcaagctggtacacgtatgcagccatgctcaggatatataaacactgggacttcaacatcatagataaagataccagcagtagtcgcctctctttcagcagttacccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatggcagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttccca

SEQ ID NO: 406276 - DNA, 737 bp, Homo sapiens
attttctgtacattattttgtaattaaatgcctgtgcccattttcaaaataaatgaacatggataacatttcttttgctctctctccttttctgtctccttccctgtcaatccctcccttacttcccttccattccaaatcaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatggcagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttccca

SEQ ID NO: 406277 - DNA, 582 bp, Homo sapiens
gcttcctcctgaaggaacatccttctgtaagccttgcttttcctcctgtaggctggcagaggacagtggagcagccaacacacaaaactaccgtttgtgcatggctaaagaccgtggtgattttatagcatcctgggcatttcacatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatggcagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttccca

SEQ ID NO: 406278 - DNA, 1965 bp, Homo sapiens
tgctggagataaatggtcgaccccggagggagaggctagtaggggtgttgatgtgaactgattcgcccaagccttgggccgcaaaactgcgaaagaaagcggcaggcagcctctgcatttcccagaagtgcagctggggaactttcccagaccggcccaggggttgctagagggtcagacgtaaaggatccgcctttcctaggcggggtgggccccaggccaccacgtgaagcgtcctcgcccctcagagcccggagcaggccgggctcaagaaagaggaaagttgaggacgccccacctcggagaggcggcgcccctgagtaggccaggagcctctcttgcaacttctgccaccgcgggccaccgcggccgcctgatcccgcagaggaaggtcgcggccgtggagcgatgacccgcggcggtccgggcgggcgcccggggctgccacagccgccgccgcttctgctgctgctgctgctgccgctgttgttagtcaccgcggagccgccgaaacctgcagacacatgaatgaccactacacaaacctctacccacagctgatcacgaaaccttccatcatggataaagtgcaggattttatggagaagcaagataagtggacccggaaaaatatcaaagaatacaagactgattcattttggagacatacaggctatgtgatggcacaaatagatggcctctatgtaggagcaaagaagagggctatattagaagggacaaagccaatgaccctgttccagattcagttcctgaatagtgttggagatctattggatctgattccctcactctctcccacaaaaaacggcagcctaaaggtttttaagagatgggacatgggacattgctccgctcttatcaaggttcttcctggatttgagaacatcctttttgctcactcaagctggtacacgtatgcagccatgctcaggatatataaacactgggacttcaacatcatagataaagataccagcagtagtcgcctctctttcagcagttacccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatggcagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttccca

SEQ ID NO: 406279 - DNA, 829 bp, Homo sapiens
ggatcccccatctggagtgccagtgtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatggcagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttcatttccca

SEQ ID NO: 406280 - DNA, 1004 bp, Homo sapiens
tgctggagataaatggtcgaccccggagggagaggctagtaggggtgttgatgtgaactgattcgcccaagccttgggccgcaaaactgcgaaagaaagcggcaggcagcctctgcatttcccagaagtgcagctggggaactttcccagaccggcccaggggttgctagagggtcagacgtaaaggatccgcctttcctaggcggggtgggccccaggccaccacgtgaagcgtcctcgcccctcagagcccggagcaggccgggctcaagaaagaggaaagttgaggacgccccacctcggagaggcggcgcccctgagtaggccaggagcctctcttgcaacttctgccaccgcgggccaccgcggccgcctgatcccgcagaggaaggtcgcggccgtggagcgatgacccgcggcggtccgggcgggcgcccggggctgccacagccgccgccgcttctgctgctgctgctgctgccgctgttgttagtcaccgcggagccgccgaaacctgcaggagtctactatgcaactgcatactggatgcctgctgaaaagacagtacaagtcaaaaatgtaatggacaagaatggggacgcctatggcttttacaataactctgtgaaaaccacaggctggggcatcctggagatcagagctggctatggctctcaaaccctgagcaatgagatcatcatgtttgtggctggctttttggagggttacctcactgccccacacatgaatgaccactacacaaacctctacccacagctgatcacgaaaccttccatcatggataaagtgcaggattttatggagaagcaagataagtggacccggaaaaatatcaaagaatacaagactgattcattttggagacatacaggctatgtgatggcacaaatagatggcctctatgtaggagcaaagaagagggctatattagaagggacaaaggtaggactttaaacaagcttctcagaatttatagagtatgg

SEQ ID NO: 406281 - DNA, 5190 bp, Homo sapiens
ccagaagttctccagggcttccgcagagcactttttcgctgcctgtgagctgcagcgcgggagagctcgggctcgcgcggaccccagcgcctggcaggctgacagcgctctctcgccccaggtgcccgcgcgcgtggtgagcagctgcaccaggtggcgtccggggtggggtcaatgaagtgcagcctgaggaagatgtggcgccctggagaaaagaaggagccccagggcgttgtctatgaggatgtgccggacgacacggaggatttcaaggaatcgcttaaggtggtttttgaaggaagtgcatatggattacaaaactttaataagcaaaagaaattaaaaacatgtgacgatatggacaccttcttcttgcattatgctgcagcagaaggccaaattgagctaatggagaagatcaccagagattcctctttggaagtgctgcatgaaatggatgattatggaaatacccctctgcattgtgctgtagaaaaaaaccaaattgaaagcgttaagtttcttctcagcagaggagcaaacccaaacctccgaaacttcaacatgatggctcctctccacatagctgtgcagggcatgaataatgaggtgatgaaggtcttgcttgagcatagaactattgatgttaatttggaaggagaaaatggaaacacagctgtgatcattgcgtgcaccacaaataatagcgaagcattgcagattttgcttaacaaaggagctaagccatgtaaatcaaataaatggggatgtttccctattcaccaagctgcattttcaggttccaaagaatgcatggaaataatactaaggtttggtgaagagcatgggtacagtagacagttgcacattaactttatgaataatgggaaagccacccctctccacctggctgtgcaaaatggtgacttggaaatgatcaaaatgtgcctggacaatggtgcacaaatagacccagtggagaagggaaggtgcacagccattcattttgctgccacccagggagccactgagattgttaaactgatgatatcgtcctattctggtagcgtggatattgttaacacaaccgatggatgtcatgagaccatgcttcacagagcttcattgtttgatcaccatgagctagcagactatttaatttcagtgggagcagatattaataagatcgattctgaaggacgctctccacttatattagcaactgcttctgcatcttggaatattgtaaatttgctactctctaaaggtgcccaagtagacataaaagataattttggacgtaattttctgcatttaactgtacagcaaccttatggattaaaaaatctgcgacctgaatttatgcagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccagttatgggcgtatcaatacctgtcagaggctcctacaagacataagtgatacgaggcttctgaatgaaggtgaccttcatggaatgactcctctccatctggcagcaaagaatggacatgataaagtagttcagcttcttctgaaaaaaggtgcattgtttctcagtgaccacaatggctggacagctttgcatcatgcgtccatgggcgggtacactcagaccatgaaggtcattcttgatactaatttgaagtgcacagatcgcttggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattgattttactgcgtgtgaaatcatggttcctgcatgctatataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaaaaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagaacacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttacag

SEQ ID NO: 406282 - DNA, 694 bp, Homo sapiens
cttaagcttctcatttatcattcattttttatttactatacatataaaacataaaataaacctaatgtttacatcccatccattttacctaacagaacatattaacatgaagctgttgggtgttatttgggggtgggaggaaataagaggaggggcagagggaagggccatgatcaaatatatttgaaaaatgctgagttaaaaatgttaagtacattttcctattggcatgatctctcagatcctttaatacagtaatgtacactaatatggtaatgtacactaaatgaagacagagcattcaacttcattcatatttatattactctcaaatcctttaggttatttacaattttggccccaaggaatacatattgacccttgttggaaaatattttcctacagaatagtttgaaaaccatcatattagcataatagcagagttatttgtatgatattaattttttcctatagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccaggtaagggtcagtctagcaatgtatgaacatgtcttctttctgtttaatat

SEQ ID NO: 406283 - DNA, 4583 bp, Homo sapiens
gagatggtaaaaatttctgaattttattatacttaaatgaactcaagtacaagaaacaaagttaaaatatgtaagtataataaaatatgtggcataattaaatgatattgtgataagaaagaaaaaacctggaaatgttttacagaggtttttcatttgatatcttaccatagcagtagcaaagagcttattaggctaatgttcaaaaacacatttccttaccataatattgatgccagcaaattggtgctacagctacatgaatgaatgttttgctcagttttttctggtttacaaagaaacaccaagcaactgacctgcaaaggggaccgaagtagacccaggccagacagttgttgcttaattacatcataactgaaatagcaacatggctcttgcaccctaaaacatctgctcactagcactgaaattaaatagtgtcaagaatttttttctgtctaatttgaaaaaagatagctaatatgacaaggctttgttgtatttacatcttgaatttctgtggaaaaggataaacatttttcaaagcaattgagtaagcatttttcagagcacaagagggaagctttttagatttaaactcttagaataataactgacactaagctaagcatcttatagccatgtatcatattactagtagtattaccaataactattgaccacaaagactaacattacttcataaaaaaattttgatacagtgttcattgaaagaataaaacaagatttaaattgatgtgtatcagttcattatagctttaaaaaaattaggtatgacacagacatgctaagcgtacttctcctaccccaaagtgtttggtaatgtgtttatatactttcatattttaaaccactaagtaaaaaacgtgtatgaatcacattagaaataggtcatttaagatcattgagcttggaattagctcatttattataaatgttttataaatatttagttgccagatctcaataatgctttttgttgtcatcagatttacctagaataagccaagtggcatcccatcccgcatttcatctgttaagtgtatgcacacatcttttcttaactctttaccagtgaccacaatggctggacagctttgcatcatgcgtccatgggcgggtacactcagaccatgaaggtcattcttgatactaatttgaagtgcacagatcgcttggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattgattttactgcgtgtgaaatcatggttcctgcatgctatataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaaaaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagaacacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttacag

SEQ ID NO: 406284 - DNA, 1961 bp, Homo sapiens
gagatggtaaaaatttctgaattttattatacttaaatgaactcaagtacaagaaacaaagttaaaatatgtaagtataataaaatatgtggcataattaaatgatattgtgataagaaagaaaaaacctggaaatgttttacagaggtttttcatttgatatcttaccatagcagtagcaaagagcttattaggctaatgttcaaaaacacatttccttaccataatattgatgccagcaaattggtgctacagctacatgaatgaatgttttgctcagttttttctggtttacaaagaaacaccaagcaactgacctgcaaaggggaccgaagtagacccaggccagacagttgttgcttaattacatcataactgaaatagcaacatggctcttgcaccctaaaacatctgctcactagcactgaaattaaatagtgtcaagaatttttttctgtctaatttgaaaaaagatagctaatatgacaaggctttgttgtatttacatcttgaatttctgtggaaaaggataaacatttttcaaagcaattgagtaagcatttttcagagcacaagagggaagctttttagatttaaactcttagaataataactgacactaagctaagcatcttatagccatgtatcatattactagtagtattaccaataactattgaccacaaagactaacattacttcataaaaaaattttgatacagtgttcattgaaagaataaaacaagatttaaattgatgtgtatcagttcattatagctttaaaaaaattaggtatgacacagacatgctaagcgtacttctcctaccccaaagtgtttggtaatgtgtttatatactttcatattttaaaccactaagtaaaaaacgtgtatgaatcacattagaaataggtcatttaagatcattgagcttggaattagctcatttattataaatgttttataaatatttagttgccagatctcaataatgctttttgttgtcatcagatttacctagaataagccaagtggcatcccatcccgcatttcatctgttaagtgtatgcacacatcttttcttaactctttaccagtgaccacaatggctggacagctttgcatcatgcgtccatgggcgggtacactcagaccatgaaggtcattcttgatactaatttgaagtgcacagatcgcttggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacggtaatttcaaattttaactttctaaaataaaggattataaaaaatgtattttttcttaagactactaaacccataataaatctgacatatcaggacttt

SEQ ID NO: 406285 - DNA, 2939 bp, Homo sapiens
atttatatagaattattagggttagtggtaaatataatataaataatatttttcggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattgattttactgcgtgtgaaatcatggttcctgcatgctatataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaaaaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagaacacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttacag

SEQ ID NO: 406286 - DNA, 460 bp, Homo sapiens
gagagctccacattcatgttgttatacggatagaaaggccccaggaattactgaaccaacttgcagtccccaagaagttttcttaagatggagtggactccacagggaaagcccagcaatttgtaggatttccttaggcgtcggattcccataacaccaggttaacagagggctctgggccatctccaacaccgattcataccccggggactctgaagtcaatccaggatggcgtgaggttactccttggtcctaaacttctccccagctggctgcaaagctagaaaaattgtattacggggtgcatgtatataaccatccatagatgctaggtctctatatgtggtaattttttattcttttctatcccagaaaaggaattattttatggatataagcaatgttcttgaatggattatctacacgacgggcatcatttttgtgctgcccttgtttgttg

SEQ ID NO: 406287 - DNA, 132 bp, Homo sapiens
agattgttaaactgatgatatcgtcctattctggtagcgtggatattgttaacacaaccgatggatgtcatgagaccatgcttcacaggcaagtttcctacctatcattctgtatacagatttttcatcttc

SEQ ID NO: 406288 - DNA, 4296 bp, Homo sapiens
cttaagcttctcatttatcattcattttttatttactatacatataaaacataaaataaacctaatgtttacatcccatccattttacctaacagaacatattaacatgaagctgttgggtgttatttgggggtgggaggaaataagaggaggggcagagggaagggccatgatcaaatatatttgaaaaatgctgagttaaaaatgttaagtacattttcctattggcatgatctctcagatcctttaatacagtaatgtacactaatatggtaatgtacactaaatgaagacagagcattcaacttcattcatatttatattactctcaaatcctttaggttatttacaattttggccccaaggaatacatattgacccttgttggaaaatattttcctacagaatagtttgaaaaccatcatattagcataatagcagagttatttgtatgatattaattttttcctatagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccagttatgggcgtatcaatacctgtcagaggctcctacaagacataagtgatacgaggcttctgaatgaaggtgaccttcatggaatgactcctctccatctggcagcaaagaatggacatgataaagtagttcagcttcttctgaaaaaaggtgcattgtttctcagtgaccacaatggctggacagctttgcatcatgcgtccatgggcgggtacactcagaccatgaaggtcattcttgatactaatttgaagtgcacagatcgcttggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattgattttactgcgtgtgaaatcatggttcctgcatgctatataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaaaaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagaacacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttacag

SEQ ID NO: 406289 - DNA, 2593 bp, Homo sapiens
taggatccccgcacgctatccggtcaatttttatgtcccatccaaaatgtatgtattagaaacctaatcaccaagaagatggcattagaaggtggggcctttgggaggtgattaggccatgaggggagagccctcatgaatggaattagttcccttataaaagagctatgagggagcttattagctcctttgcctttctgccatatgggaacacatagaaggtgccacctatgaggaatgggttcttaccagaaaccagttctgcccgagtctttattttggacttcccagcctgcagaaccataagcaattaacttatgctatttatacactacccagactaaaatattttgtcacagcagtctgaatggactaagacagaccttacatgcatttttaggtggaccattcaactgtagtgatttaattttgtgtcataattcagattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattgattttactgcgtgtgaaatcatggttcctgcatgctatataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaaaaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagaacacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttacag

SEQ ID NO: 406290 - DNA, 1825 bp, Homo sapiens
tttaagaaaaatatatttgaattctacatttatggataattcagttagtatatagtatgtgacagttgaatttgtgctgtatacattgtcattgacttaaaaattaacttttactctaatgtgtagtatgccatttttatttttcaaatatgaataagaatatcattatataaataatataaatattgctaatatatgaaaaaaataaacactcattgtctttcatcctagtacaaggattaataccatcgtaggatattttcatcctggcttttttttcaaagttataatcctaataggcatgtaaagttagtatactacttctgcttaatgttatctcattgcgtatttatagttgtctgttactgtagtcatcataatcttcagctaaagtttatgatagattcactggagcgatgtaacatctccttaaaattccctgtgattgaatagtttggtcatttccaatttttttatgtacaaacaaaatggatttccctaagtggattttccaacaaaggacccacagctggagtatataaaagacttgtacaaatcagtaataaaaagacagaacctaatacaaaaaatagcaatgttggcaagcagcttaattaggtactttgcaaaacggcttgccaagtggcaaataggaatatgaaaagatgcccaacagcacattactcaatgataattaaatgagaattaaaacaacaaaatgaaatatgactgcatacccactataattgcaaacattaaaaaacaagaaaatgcccattatcgtaagtatgtagtgaaacaggatttattttatactgcaggaatgatgtaaatgggatgccactattctagaaaccgtttggttttttgtacgtagttgaacgtatggacatgaactgtactccagccattccatttctatttatatacccattagaaatgtatgaccatgcatactaaatgacatgtacaagaatttttatggcagcattatttataatagccaccaaaccagaaatcacctaagtgttccatcaatagtattcatgcaacaaaatactatatagcaatgaaattgatccaactatacccatatgtagcaacatggataaataaggttttttttgtacccaattgatagttattttaacagctggttatgtgagtgtggataaatttgtactgcagttaaaattactttttttttggtaaatacatttctatcttctatcactgatgcttttcaaatttgtaataataggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaatttt

SEQ ID NO: 406291 - DNA, 467 bp, Homo sapiens
tacatggagtttggaaagaatcaagtatttattcagagatattgtattctaaaattgacagttccaacagggctaattgtagtgagaattttagtttgaccaactcttcatgtttgttagagactattacagtttctctttggagaaaaggtacatatttacttgatattttattttagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtaagttgtgaaggaagactgattctaattttatcatttctaaaaaatttagctattaaaatctattatttagcaaaataattaaatgtgtggtactcatatatagacaaatgggccaggcacagtggctcatgcctgtaa

SEQ ID NO: 406292 - DNA, 327 bp, Homo sapiens
ctcccgctgcgttcccaacccggcttcattccgtacgacgaggcgaagacctgggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaatttt

SEQ ID NO: 406293 - DNA, 2795 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406294 - DNA, 2681 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctgtaagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406295 - DNA, 2570 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagtaagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406296 - DNA, 2464 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaatttt

SEQ ID NO: 406297 - DNA, 2728 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406298 - DNA, 2899 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcaggtaatgcatattttattttcacttctataaagagagttcatggattctgtatgctctcaacaacttttagaaagatttgtatttttactgtacttttaaaaatttgttaaaactttgtagagttagtagatatttttatggttacctttgggatggcttatgcatatccatattttaaaatgtaaatctcccccaaattaagcaaattcaaaaaactatagcacaggggaatatagaattaaaactataaatcaaaaacattttattaagcactttttaaatgtgtttttaattttcctgtccatttttagagactcaacagttgttaagtacaggtctccagcttggtatttatccagcagtagctagctctctgttctgaatgtttcgttcacagcaccagctgtttgggggcttaaatacagtggtattcctgttaactccctctccaaaaaaaatttttaagcccagatttggccgggcatggtggctcacgcctgtaatgttagcactttgggaggctgagccacggcaaccggccagtgaatttatgttttgttttaaacaatttatttggaaatat

SEQ ID NO: 406299 - DNA, 2055 bp, Homo sapiens
agcggctttgtataatctcaaaaaatgttggcttgctgcaattaaaatggaaaaatactaaacgtttacatgtgagctttttttccgctagtaagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaaggcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406300 - DNA, 2156 bp, Homo sapiens
tttaagaaaaatatatttgaattctacatttatggataattcagttagtatatagtatgtgacagttgaatttgtgctgtatacattgtcattgacttaaaaattaacttttactctaatgtgtagtatgccatttttatttttcaaatatgaataagaatatcattatataaataatataaatattgctaatatatgaaaaaaataaacactcattgtctttcatcctagtacaaggattaataccatcgtaggatattttcatcctggcttttttttcaaagttataatcctaataggcatgtaaagttagtatactacttctgcttaatgttatctcattgcgtatttatagttgtctgttactgtagtcatcataatcttcagctaaagtttatgatagattcactggagcgatgtaacatctccttaaaattccctgtgattgaatagtttggtcatttccaatttttttatgtacaaacaaaatggatttccctaagtggattttccaacaaaggacccacagctggagtatataaaagacttgtacaaatcagtaataaaaagacagaacctaatacaaaaaatagcaatgttggcaagcagcttaattaggtactttgcaaaacggcttgccaagtggcaaataggaatatgaaaagatgcccaacagcacattactcaatgataattaaatgagaattaaaacaacaaaatgaaatatgactgcatacccactataattgcaaacattaaaaaacaagaaaatgcccattatcgtaagtatgtagtgaaacaggatttattttatactgcaggaatgatgtaaatgggatgccactattctagaaaccgtttggttttttgtacgtagttgaacgtatggacatgaactgtactccagccattccatttctatttatatacccattagaaatgtatgaccatgcatactaaatgacatgtacaagaatttttatggcagcattatttataatagccaccaaaccagaaatcacctaagtgttccatcaatagtattcatgcaacaaaatactatatagcaatgaaattgatccaactatacccatatgtagcaacatggataaataaggttttttttgtacccaattgatagttattttaacagctggttatgtgagtgtggataaatttgtactgcagttaaaattactttttttttggtaaatacatttctatcttctatcactgatgcttttcaaatttgtaataataggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406301 - DNA, 1656 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaaggcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaaggtatttatgcttaacatatgaaaaattatcctgattatattagttgcttaaattcccttactattgtgttaggcattaaataccttttctcattcaagggggggcaggtattttaatagcttttggaacaattatttaataaaatgggggcct

SEQ ID NO: 406302 - DNA, 1464 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggtacctatataaagtgaagatttaaagaaagcatcattgagcaagtacttttcactactgaaatataattaaccacatgatgtcattaactatacctgatatacattattaatttgtaagaataatagaaaagcaaaatttagtaaaacc

SEQ ID NO: 406303 - DNA, 1026 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgcaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaagtatggatttaccaatatatgaagattaggatattttttattagaatataatatgagagaatctccataaaaaatgtaatatgctgtctcacattttatagtgttgataatggtttttaacatcgatttggtccatgatattgtgacctctaaaagatgtatctgtatcaaaatgttattatcaaggagtatgtgtaataatgtttattaatgcctgacctcccaccttgatgtttttggacaggttaaaaaaaatgtgcagtatcttactttcaaagcattgaaaacgatcgtttttacctgtataaatatattttttttaacatggaagcatctatagagattttagatgtcatgtattaaaatcttccctgctgtaataaaaaatttcctctaccaataaaaaaaagcc

SEQ ID NO: 406304 - DNA, 852 bp, Homo sapiens
gaaatcttttagaaatttttatttaaccataaactataaaatggggagaatgtaattcagctaacagtatcactatgagattatattagcaagatttcttagataactgtcattgtaaaccagccatgtgttttgattaacagggtagcagcatgtctaccagaaaaatggtttgaaaattctgccatgaggacatctattccacagctagaaaacttcattcagtttttattgcagtctgcacataaattatctagaagtgaattcaggtaatgcatattttattttcacttctataaagagagttcatggattctgtatgctctcaacaacttttagaaagatttgtatttttactgtacttttaaaaatttgttaaaactttgtagagttagtagatatttttatggttacctttgggatggcttatgcatatccatattttaaaatgtaaatctcccccaaattaagcaaattcaaaaaactatagcacaggggaatatagaattaaaactataaatcaaaaacattttattaagcactttttaaatgtgtttttaattttcctgtccatttttagagactcaacagttgttaagtacaggtctccagcttggtatttatccagcagtagctagctctctgttctgaatgtttcgttcacagcaccagctgtttgggggcttaaatacagtggtattcctgttaactccctctccaaaaaaaatttttaagcccagatttggccgggcatggtggctcacgcctgtaatgttagcactttgggaggctgagccacggcaaccggccagtgaatttatgttttgttttaaacaatttatttggaaatat

SEQ ID NO: 406305 - DNA, 816 bp, Homo sapiens
gtgtgaatatactcccaccattgcttccaccacaatgtctcatacaagctaatagcaacgcagcactactgaaatttctgatagacttactatatgcttttctaccttttacagtaattcacattgaaatttgccagaatacatccactaatgatctgtatttgaactttataattaagtggagatggcagcatctctctgtgttttatgctactttagatattggcttaaggtaaagcttttgttttagattaacaactgatgatcaggttctgaattgaccgctgttccctcatacattgcatttttaaagggagaaatttgttttgtttttcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406306 - DNA, 464 bp, Homo sapiens
caatggcgagaaaagtttcctgactcctattatgaagctttcattagtttatgcataccaaagcttttaaatcccctaatacgagttcagttgattgattggaatcctcttaaggtatttatgcttaacatatgaaaaattatcctgattatattagttgcttaaattcccttactattgtgttaggcattaaataccttacccttagagtcggagctgaaatttagagctttggaacaatagtcagaaaatgtgtgctttcggctacattcttcttttcttggctgtcacttgatttttaggctaagcatcattaacatcagtaaagcaaacacatttttttttagcttcttgtacattaaatttaaaatcctcccagaaagtataaggtactgttgggtttggagaaagtagatataaaagccttgtttcaagaattcttaagttggagatgacatactggg

SEQ ID NO: 406307 - DNA, 740 bp, Homo sapiens
tagataactgtcattgtaaaccagccatgtgttttgattaacagggtagcagcatgtctaccagaaaaatggtttgaaaattctgccatgaggacatctattccacagctagaaaacttcattcagtttttattgcagtctgcacataaattatctagaagtgaattcaggtaatgcatattttattttcacttctataaagagagttcatggattctgtatgctctcaacaacttttagaaagatttgtatttttactgtacttttaaaaatttgttaaaactttgtagagttagtagatatttttatggttacctttgggatggcttatgcatatccatattttaaaatgtaaatctcccccaaattaagcaaattcaaaaaactatagcacaggggaatatagaattaaaactataaatcaaaaacattttattaagcactttttaaatgtgtttttaattttcctgtccatttttagagactcaacagttgttaagtacaggtctccagcttggtatttatccagcagtagctagctctctgttctgaatgtttcgttcacagcaccagctgtttgggggcttaaatacagtggtattcctgttaactccctctccaaaaaaaatttttaagcccagatttggccgggcatggtggctcacgcctgtaatgttagcactttgggaggctgaggcaggaggatcacttgagcccaggagtttgagaacagcctggga

SEQ ID NO: 406308 - DNA, 2664 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagct

SEQ ID NO: 406309 - DNA, 2825 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcaggtgtccagggagacgcggggaagcggggagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406310 - DNA, 2833 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggtacctatataaagtgaagatttaaagaaagcatcattgacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406311 - DNA, 1119 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaagtatggatttaccaatatatgaagattaggatattttttattagaatataatatgagagaatctccataaaaaatgtaatatgctgtctcacattttatagtgttgataatggtttttaacatcgatttggtccatgatattgtgacctctaaaagatgtatctgtatcaaaatgttattatcaaggagtatgtgtaataatgtttattaatgcctgacctcccaccttgatgtttttggacaggttaaaaaaaatgtgcagtatcttactttcaaagcattgaaaacgatcgtttttacctgtataaatatattttttttaacatggaagcatctatagagattttagatgtcatgtattaaaatcttccctgctgtaataaaaaatttcctctaccaataaaaaaaagcc

SEQ ID NO: 406312 - DNA, 2944 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcaggtaatgcatattttattttcacttctataaagagagttcatggattctgtatgctctcaacaacttttagaaagatttgtatttttactgtacttttaaaaatttgttaaaactttgtagagttagtagatatttttatggttacctttgggatggcttatgcatatccatattttaaaatgtaaatctcccccaaattaagcaaattcaaaaaactatagcacaggggaatatagaattaaaactataaatcaaaaacattttattaagcactttttaaatgtgtttttaattttcctgtccatttttagagactcaacagttgttaagtacaggtctccagcttggtatttatccagcagtagctagctctctgttctgaatgtttcgttcacagcaccagctgtttgggggcttaaatacagtggtattcctgttaactccctctccaaaaaaaatttttaagcccagatttggccgggcatggtggctcacgcctgtaatgttagcactttgggaggctgaggcagaggtgggaagattgcttgagcctgagaggttgaggctgcagtgagctatgattgtgccactgtactccagtctgaccagcagagccaagaccaagtcc

SEQ ID NO: 406313 - DNA, 2670 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtagaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatat

SEQ ID NO: 406314 - DNA, 1497 bp, Homo sapiens
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcagtggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggtacctatataaagtgaagatttaaagaaagcatcattaataggagtcaggaaacttttctcgccatatgctgaaatattcaacaaaatattctggatgtaacaaaaatcatcttgcacttcttcaaaaactatgttctgtttctgtaaaatgtcaacattggctatcttggaagtcaattat

SEQ ID NO: 406315 - DNA, 625 bp, Homo sapiens
  misc_feature (490)..(491): n is a, c, g, or t
  misc_feature (509)..(509): n is a, c, g, or t
  misc_feature (526)..(526): n is a, c, g, or t
  misc_feature (529)..(530): n is a, c, g, or t
  misc_feature (591)..(591): n is a, c, g, or t
  misc_feature (608)..(608): n is a, c, g, or t
gcgggagcgcgccctagggggcgggcactgtgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagacagtgtnncctcgtctttggtttccnttcaagttacagatccncanngatgcagcattttaattcacgtgcagccccgcagaaaaacggtgacattggggccaggggncccccaacgaatgcacntaatactttcctttcgc

SEQ ID NO: 406316 - DNA, 539 bp, Homo sapiens
  misc_feature (492)..(492): n is a, c, g, or t
  misc_feature (524)..(524): n is a, c, g, or t
cgaggccggaactggcggactgcggcgcacttccgtagaggtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcccacggaatcctgttagtttctaccacctcctcccccttctctggagctggtggagcttcagaagtcctgtggagcgtcggctgggatcagtttgtctcggtgaaaagtaaactttgaaagctttccagagtgttgaatcttccaccagaaaacttgatcacatcaatatctgcagttccaatttcccaaaaagaagaagtagctgattttcagctttctgtggattctttattggaaaaagacaatgaccattcaagaccaggaagcccactttcaccccttctattcaacacaggactggaagttctngccagagccatcagtccagagaaataaataangggcatccaaatcag

SEQ ID NO: 406317 - DNA, 606 bp, Homo sapiens
aatttggatttctttccctttaatgtaggcaggggaaatgtcattatcaaaggtaaaatagcctaaattaggcaagtaattactcattctgaatctgttcttgattgtcagcatacatttttggcagatgttaccttcacttggatccatgattggcacagtgtcatgtagactaaagatagctgcctttgtctgtttcagcaactaaagaactcaagaacccacaagagactgcagagagggtcgggctcgcagcactcattattcaggtctgttaagactcctacctgtgaggcccttttgtttggtactagagcaaatcccagcagtgaagatttcctctgtcgttttaggacttcaaaggtttactcttatctgactacaagttcagctgggatcgtgttttccagagtcgcggggacacaggagtcttcctacagtacacacacgcccgcctccacaggtgagaagaggctgcagggaaaccttgtgctgcactgtgcttacttaggctaggtcctgtgattctaagaccagaggccctgttttctgggcttttccaatatcttctattcacatctgactagagtagaccttcttttagga

SEQ ID NO: 406318 - DNA, 1812 bp, Homo sapiens
tgttcctgaattatttaagtttcttatagattctggatattagacctttcttagatgcatagcttatgaatattttctcccattatttaggttgtagggaaagggagagcttttgattttttttaagcattacagataatgttgaagtcactgatatatatttgtttgactgcattccctaccctgcttccctagagagaactgatctcatgatgcaaatgatttattttcacgaatcagttgctttgtgtttgtttctttgtttttgtatttttttttcacctacccagtgaaaaggataaatggcattgtccatctctttaatgaactactgagtgttaagaagaatattcttctttttctcatgttgaaactcaaattacaacatttaaaaaatatgtcatttggaggtcagtggagaggtttgaattagaagcatgtatttggagtagtagaggaagcattgtagaagaggtaaagagacctgggcttttttctcagtctgtttttttttgcagtaggattttaaaggagacatttagcttgccagacatcagttttcatgtctataaaataaggtggctagtataagaggaagaattttttgagactaggtcttgctctgtcacccagactggagtgcagtggcatgatctcagctcactgcaacctctgcctcctgggttcaagcaattctcgtgcctaagcctcccgagtagctgggcttacgggcacatgccaccacgcctggctaatttttgtatttttagtagagatggggtttttccatgttggccaggctggtctcaaactcctgaccttaagtggtccacttgcctcggcctcccaaagtgctgggatctgtgcccagacagaagaggaagaattttataagatgataagaaaaacattctgaataaatactaggttatttctcattttcttgcttttaattttgttttttatttatttattttattttatttacttttttgagacagagtttcgctcttgtcacccaggctggagtgcagtggcacaatcttgactcgctgcagtctccacctccaggattcaagcgattcccctgcctcagtctcccaagcagctgggattgtaggtacacaccaccatgcctggctaatttttgtgtgtgtgtgtgtatttttagtagagatggggttttaccatgtggccaggctggtctagaactcaacctcaggtgatccgcctgccttagcctcccaaagtgctgggattacaggcatgagccaccgctctcggcccccttgcttttaattttgaaagtacacataacaccttcttctggtaaaggtatgtctcaatggagaactcatagtgattagtctttgtttaacaactaatgcttttaaggtaacagttctatctcgtttcgatgtctgtctttagagaagtagctgattttcagctttctgtggattctttattggaaaaagacaatgaccattcaagaccagatattcaagttcaagccaagagactagcagagaaggtacgttagcactattatctctttttgacattgtaataaacttgttattaaaaaaagtactttgcaggctatctcagccataatagtgaatttaatagtgtttctttgaggcatcttgtgtaatataatttaaattcattttagccatgtactataaggttataatgatttttcagattagttataaagcactcctcttgagctgacattgttcaattttttgattaaccacttacaggaagactgaagtgttaattaaatttacagattgaagctgg

SEQ ID NO: 406319 - DNA, 932 bp, Homo sapiens
cgaggccggaactggcggactgcggcgcacttccgtagaggtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcccacggaatcctgttagtttctaccacctcctcccccttctctggagctggtggagcttcagaagtcctgtggagcgtcggctgggatcagtttgtctcggtgaaaagtaaactttgaaagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtctagagacaagatcgctatgtagacacaccgtgaaccatttcccactgtgggcctgcaccaccccaggggcttcctagcttctgctcttctggaagtcttccccatctcctccccattccaggtaatt

SEQ ID NO: 406320 - DNA, 576 bp, Homo sapiens
gcaggacttcaaaggtttactcttatctgaataatgagtgctgcgagcccgaccctctctgcagtctctgtgggttcttgagttctttagttgtcttaattgaagccatgttctgacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406321 - DNA, 504 bp, Homo sapiens
ttttgtatttttagtagagaatggggtttcatcatattggccaggctgctctcaaactcctgacctcatgatccacccacctcagtctcccaaagtgctgggattacagacgtgagacactgcgcctggccataccttctactcttaatcgtgtcgagtcaaccttatattcacaatcttttaatgtctaatgtcttagtgtaatgtgtacagtcttttcctgttcactgttcctgtcatcttttagggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406322 - DNA, 870 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggaga

SEQ ID NO: 406323 - DNA, 2034 bp, Homo sapiens
cgaggccggaactggcggactgcggcgcacttccgtagaggtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcccacggaatcctgttagtttctaccacctcctcccccttctctggagctggtggagcttcagaagtcctgtggagcgtcggctgggatcagtttgtctcggtgaaaagtaaactttgaaagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406324 - DNA, 2027 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaacatttaacaattgggttttcacaactgtcctcatcccctccctccccacacactctcgggggctcctattcccgggctcccgccacacgacgtctcccacatgggcccctcggctcctccgctggtccccggacccagcttctttcgccccagcggggaccatcccgcggcccccctaaccggcccgctcattccgcatcagcccggtctgagt

SEQ ID NO: 406325 - DNA, 3088 bp, Homo sapiens
tgttcctgaattatttaagtttcttatagattctggatattagacctttcttagatgcatagcttatgaatattttctcccattatttaggttgtagggaaagggagagcttttgattttttttaagcattacagataatgttgaagtcactgatatatatttgtttgactgcattccctaccctgcttccctagagagaactgatctcatgatgcaaatgatttattttcacgaatcagttgctttgtgtttgtttctttgtttttgtatttttttttcacctacccagtgaaaaggataaatggcattgtccatctctttaatgaactactgagtgttaagaagaatattcttctttttctcatgttgaaactcaaattacaacatttaaaaaatatgtcatttggaggtcagtggagaggtttgaattagaagcatgtatttggagtagtagaggaagcattgtagaagaggtaaagagacctgggcttttttctcagtctgtttttttttgcagtaggattttaaaggagacatttagcttgccagacatcagttttcatgtctataaaataaggtggctagtataagaggaagaattttttgagactaggtcttgctctgtcacccagactggagtgcagtggcatgatctcagctcactgcaacctctgcctcctgggttcaagcaattctcgtgcctaagcctcccgagtagctgggcttacgggcacatgccaccacgcctggctaatttttgtatttttagtagagatggggtttttccatgttggccaggctggtctcaaactcctgaccttaagtggtccacttgcctcggcctcccaaagtgctgggatctgtgcccagacagaagaggaagaattttataagatgataagaaaaacattctgaataaatactaggttatttctcattttcttgcttttaattttgttttttatttatttattttattttatttacttttttgagacagagtttcgctcttgtcacccaggctggagtgcagtggcacaatcttgactcgctgcagtctccacctccaggattcaagcgattcccctgcctcagtctcccaagcagctgggattgtaggtacacaccaccatgcctggctaatttttgtgtgtgtgtgtgtatttttagtagagatggggttttaccatgtggccaggctggtctagaactcaacctcaggtgatccgcctgccttagcctcccaaagtgctgggattacaggcatgagccaccgctctcggcccccttgcttttaattttgaaagtacacataacaccttcttctggtaaaggtatgtctcaatggagaactcatagtgattagtctttgtttaacaactaatgcttttaaggtaacagttctatctcgtttcgatgtctgtctttagagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406326 - DNA, 2259 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggtatgatgttttccagggatcatcaagtgtgcttctgcttatcaaaatggctattagcatttttgctgcccagtagagtcaacagtccagtagctgccttctgcctctagacttttcccaaaggtatgccttaaaaagtgattatttgcattttgaggacagagggcatagattaagccaatgcccaaggaggacagtctttgggtcttcagaatattatcactgatgaatagcgcacatgtctagctgcctctagctcacataaagccttataaaagcataaccttttttagttttagtttgagaaagagcatcttcttgctctctgtggtaagtgaaggaaaatacctgcctttgtgcagcttcccagagaccgtaagtccttcatttgcctcttggtttcggttcacaatctcaaatacatatatgtatgtgatgctcccatgctaggcaagacacccacacattttagctctgacgggcattgttggtgaagccaaacatgccagagattagtctctagaagggatgtggatggttatgaacaaggtggttttctttgattgccatatagtagtcagtggttctttcctggaatcagaaaaatttactcacatgtacaatagggaatgtacggaaaaataagccaactgggttttcttagcattgagggtagactttgctaatttatattttatattc

SEQ ID NO: 406327 - DNA, 2157 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagatggtgtctcgctctgttgtccaggctggagcgtgatctcggctcactgcaacctccacctgctggattcaagcgattctcctgcctcagcctccctagtagctgggattacagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaaaaaaaaaaaaaaaagaacgaaaaacaaaacaaacaaaaacacgacggggcctacatagatccgggggggggcggggaaaagagcgtatatggacaggggaccatggggtccaatacgtggtttctgaccccaggtttctgtgtgcacaaggggggaaaagctgccggggtcccccaatgggggggcggatgaactcggaaagccggggacccggaaagtacgcacaaaaa

SEQ ID NO: 406328 - DNA, 1936 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggtatgatgttttccagggatcatcaagtgtgcttctgcttatcaaaatggctattagcatttttgctgcccagtagagtcaacagtccagtagctgccttctgcctctagacttttcccaaaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406329 - DNA, 1626 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406330 - DNA, 1604 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacaggtgagaagaggctgcagggaaaccttgtgctgcactgtgcttacttaggctaggtcctgtgattctaagaccagaggccctgttttctgggcttttccaatatcttctattcacatctgactagagtagaccttcttttagga

SEQ ID NO: 406331 - DNA, 1476 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagagtgaattcagttttttcttattaaagtcataacttacgtgccacttttatgttattctggactttgggcagtgtgatttattatgtctgtccctccattgaagtgtcactaactttgtcaaaaatacctttcactaattagaggtgccagaatttttatactcgctactcaggaattggtcacttcaataatc

SEQ ID NO: 406332 - DNA, 1673 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcaggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406333 - DNA, 731 bp, Homo sapiens
aatttggatttctttccctttaatgtaggcaggggaaatgtcattatcaaaggtaaaatagcctaaattaggcaagtaattactcattctgaatctgttcttgattgtcagcatacatttttggcagatgttaccttcacttggatccatgattggcacagtgtcatgtagactaaagatagctgcctttgtctgtttcagcaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406334 - DNA, 1009 bp, Homo sapiens
cgaggccggaactggcggactgcggcgcacttccgtagaggtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcccacggaatcctgttagtttctaccacctcctcccccttctctggagctggtggagcttcagaagtcctgtggagcgtcggctgggatcagtttgtctcggtgaaaagtaaactttgaaagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtctagagacaagatcgctatgtagacacaccgtgaaccatttcccactgtgggcctgcaccaccccaggggcttcctagcttctgctcttctggaagtcttccccatctcctccccattccaggtaatt

SEQ ID NO: 406335 - DNA, 815 bp, Homo sapiens
aatttggatttctttccctttaatgtaggcaggggaaatgtcattatcaaaggtaaaatagcctaaattaggcaagtaattactcattctgaatctgttcttgattgtcagcatacatttttggcagatgttaccttcacttggatccatgattggcacagtgtcatgtagactaaagatagctgcctttgtctgtttcagcaactaaagaactcaagaacccacaagagactgcagagagggtcgggctcgcagcactcattattcaggtctgttaagactcctacctgtgaggcccttttgtttggtactagagcaaatcccagcagtgaagatttcctctgtcgttttaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406336 - DNA, 935 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggtaagtgtttagtttcacataaaatgctaaacgttcctttgaggaagtatttgatagttcaatttaatgttttaatgcttaaataacaaaatagcaaaaaacaaaaagtttaaatttatatgagcctcctgccaattcaggaaatggatgacattggttaccactgttttgtggaaacacaaaattgatttcaaaaccaaaagattcactgagaaactaattttaactgctatatatgttatgatttttaactttctaaaaataagtataaatatggggaagacctgaaagatgcaaaagtaaaaatagttatgtggggatgtataacctttcagatttttttgttcatttattttgtggtttttttgtcacttaggcagaggttgcagtgagctgcgcaccactgcactacagcctgggtgacagagctaggttctg

SEQ ID NO: 406337 - DNA, 549 bp, Homo sapiens
atgttagaaatacatttatgtgtattatcttagtcctcagaataaccctgtcgaaaaatatactgttacctccactgtgtatggatattaaggagaccaaaattgtgtattataaggtcatgttcatcacttgcagctctgtgcccttgtatgactttttaatcttttgatgtttttaactttaaacttttgataagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406338 - DNA, 385 bp, Homo sapiens
tttaaacaaaaataatgaggtcctcgccatcttgcccaggctgggcttgaactcctgggcgcaagtgatcctcctgcctcagcctcccaaagtgctgggattatgggcatgagccaccacactcagcccttgatttaatttttattgtgttcatgtgtgtgacaggtggtagagcatccttaattttgccttagggtaagaataggagattcaattaacatttctttgtctttttgtttctgaactcttttagcgtctgggagtatattttgatgaatattcaggagaatcattttatcgtgaaaaatctcaagaggtcttaaagttgctggagagtaaaggactcctactgaaaacaatgtatgatcaggttactattcttcag

SEQ ID NO: 406339 - DNA, 1813 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406340 - DNA, 563 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagagctggagtgcagtggcacaatcttgactcgctgcagtctccacctccaggattcaagcgattcccctgcctcagtctcccaagcagctgggattgtagagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagggtagcaagacctctttacaaagg

SEQ ID NO: 406341 - DNA, 1975 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaaaaaaaaaaaagagggggggtaaaatactgaggggcaattggtacggtttgaaaggccataggggttagagaagggggtaaggggggaaggtgatttgagactcttgggaatggaacagagtggaatagtagagtcggggtattagtgaaggggaagaagaaa

SEQ ID NO: 406342 - DNA, 1913 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaacatcctacatacaggtgttattccaagaagtttcattccattggctaggacagaacggacagctttggtcgacgcgggggggaatttagtagtagtaggc

SEQ ID NO: 406343 - DNA, 1978 bp, Homo sapiens
cgaggccggaactggcggactgcggcgcacttccgtagaggtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcccacggaatcctgttagtttctaccacctcctcccccttctctggagctggtggagcttcagaagtcctgtggagcgtcggctgggatcagtttgtctcggtgaaaagtaaactttgaaagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcaggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406344 - DNA, 1619 bp, Homo sapiens
  misc_feature (1570)..(1570): n is a, c, g, or t
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcagtcgacgggtgctnttaaatcatctcgtctcttctcttgtacatctctctcttctggaccccc

SEQ ID NO: 406345 - DNA, 1722 bp, Homo sapiens
agcagtcttcccatctcagtctcccaaagtgctgagattacaggcatgagccattgtgctgggggtatttttacatttttaaattttgatttctgatacagtaaatactagcagataccacttacgtgaatgctattacttcaggagtcacaagatcaatttcattaacacaatgtcaaaatttcgagttctaatttatctttgctctaaatttttaacttttaacttatctttgccctaataccaaaggccatactccacagttttgtcaaagtatggaggcatgacctagttgattcttagaagtcttaagtcttagaatagagaaatgtttcccattttttttgcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406346 - DNA, 1688 bp, Homo sapiens
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggtctgttaagactcctacctgtgaggcccttttgtttggtactagagcaaatcccagcagtgaagatttcctctgtcgttttaggacttcaaaggtttactcttatctgactacaagttcagctgggatcgtgttttccagagtcgcggggacacaggagtcttcctacagtacacacacgcccgcctccacaggtgagaagaggctgcagggaaaccttgtgctgcactgtgcttacttaggctaggtcctgtgattctaagaccagaggccctgttttctgggcttttccaatatcttctattcacatctgactagagtagaccttcttttagga

SEQ ID NO: 406347 - DNA, 1820 bp, Homo sapiens
cgaggccggaactggcggactgcggcgcacttccgtagaggtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcccacggaatcctgttagtttctaccacctcctcccccttctctggagctggtggagcttcagaagtcctgtggagcgtcggctgggatcagtttgtctcggtgaaaagtaaactttgaaagagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcaggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaa

SEQ ID NO: 406348 - DNA, 1156 bp, Homo sapiens
cgaggccggaactggcggactgcggcgcacttccgtagaggtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcccacggaatcctgttagtttctaccacctcctcccccttctctggagctggtggagcttcagaagtcctgtggagcgtcggctgggatcagtttgtctcggtgaaaagtaaactttgaaagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggtaagtgtttagtttcacataaaatgctaaacgttcctttgaggaagtatttgatagttcaatttaatgttttaatgcttaaataacaaaatagcaaaaaacaaaaagtttaaatttatatgagcctcctgccaattcaggaaatggatgacattggttaccactgttttgtggaaacacaaaattgatttcaaaaccaaaagattcactgagaaactaattttaactgctatatatgttatgatttttaactttctaaaaataagtataaatatggggaagacctgaaagatgcaaaagtaaaaatagttatgtggggatgtataacctttcagatttttttgttcatttattttgtggtttttttgtcacttaggcagaggttgcagtgagctgcgcaccactgcactacagcctgggtgacagagctaggttctg

SEQ ID NO: 406349 - DNA, 4547 bp, Homo sapiens
  misc_feature (87)..(87): n is a, c, g, or t
cgcccagcagttgctcagtcgtcggcgcgcgcggctgggagcggtagctgtgcctcggcgtccccgagctggtgccgagcgcagcgncccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctca

SEQ ID NO: 406350 - DNA, 475 bp, Homo sapiens
agcctgggccccgctcgtacagttgcgcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcaggtacggcggggagtgggcgtc

SEQ ID NO: 406351 - DNA, 839 bp, Homo sapiens
cgtcctccctggctagctggagtcaacgtcatccacaaaaagcccccagccgaggacagattcctcttcctccctgtgctctccacacccaaacctctccagtgggacatgcactgcaggttttctagtcagaagaccatcggggtgttgtttacaacaccacccccaggcagcaggaagggctcaggccagaggtagaagagagccctgggtctgagtgatcatgaaattaagcccaaggacctaccgggtgctggccacaggcctgttggggtttccaaactctctccctgaatccacatcgaagggatctgagccgagagaggaaagtggcctctaagtgagctcagagcaggaccaggcctcccaccccccaggctttggagggccttggttcccaccccgccaaggctcaccgatctcctcctcctgggggctctccttggcattggccaagaactcctgctccgcctgcagcacctcctccgggctgccgcaggccgcgtacttgtccaggagctggcggttcaggtccaagaagcccttgccccatttaaacttccgcagcaaaatgacagcaaggtctggaaagcctgacggtgtgagaaacaggaaacccaaagaagtcgacggtcccctcaagtgcctcctgatcaccctgctgccggatggcggcgctctcccaagtaaccgcagggtccccagcaaacatcagctcacagtcctgagaacccgtgctgcccccagcctgcacctcccttgctacagtccacacctctgcaaccgaccaagtccccctcctttgctgcgaaacaaacattcccaccaagactgcccca

SEQ ID NO: 406352 - DNA, 4627 bp, Homo sapiens
  misc_feature (87)..(87): n is a, c, g, or t
cgcccagcagttgctcagtcgtcggcgcgcgcggctgggagcggtagctgtgcctcggcgtccccgagctggtgccgagcgcagcgncccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgggtgcagcgccgcgtgtcagcgtgggtgggggcggctggcagggcaggccccacgtcagcgtgctgcccccacccaggtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctca

SEQ ID NO: 406353 - DNA, 3885 bp, Homo sapiens
agcctgggccccgctcgtacagttgcgcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgggtgcagcgccgcgtgtcagcgtgggtgggggcggctggcagggcaggccccacgtcagcgtgctgcccccacccaggtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctca

SEQ ID NO: 406354 - DNA, 5563 bp, Homo sapiens
  misc_feature (87)..(87): n is a, c, g, or t
cgcccagcagttgctcagtcgtcggcgcgcgcggctgggagcggtagctgtgcctcggcgtccccgagctggtgccgagcgcagcgncccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgggtgcagcgccgcgtgtcagcgtgggtgggggcggctggcagggcaggccccacgtcagcgtgctgcccccacccaggtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaaggtgaggtgggaccctctgtggggcgggggtgtggatgaggggactgagttcaaactgcagccccacacgggctgtgtccttgagcatgaggtggccccacgggcagtcaggtctccaagtgccagcgctgaccaccagcacccaggggcccctcctgatgcgcttccccctgcagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagtctctctgccgtttcttgattcctttccaaacctcagccggggccctggcctcagccccccgtccctgcgtctgctcctcttcacagcagctgctgctggctcctccgcgctcggcgccaggccctgggtcctcagacgcatcactgtcatcagtgtccgagggcagccgggtgctggccacaggcctgttggggtttccaaactctctccctgaatccacatcgaagggatctgagccgagagaggaaagtggcctctaagtgagctcagagcaggaccaggcctcccaccccccaggctttggagggccttggttcccaccccgccaaggctcaccgatctcctcctcctgggggctctccttggcattggccaagaactcctgctccgcctgcagcacctcctccgggctgccgcaggccgcgtacttgtccaggagctggcggttcaggtccaagaagcccttgccccatttaaacttccgcagcaaaatgacagcaaggtctggaaagcctgacggtgtgagaaacaggaaacccaaagaagtcgacggtcccctcaagtgcctcctgatcaccctgctgccggatggcggcgctctcccaagtaaccgcagggtccccagcaaacatcagctcacagtcctgagaacccgtgctgcccccagcctgcacctcccttgctacagtccacacctctgcaaccgaccaagtccccctcctttgctgcgaaacaaacattcccaccaagactgcccca

SEQ ID NO: 406355 - DNA, 1193 bp, Homo sapiens
  misc_feature (134)..(134): n is a, c, g, or t
  misc_feature (139)..(140): n is a, c, g, or t
  misc_feature (142)..(142): n is a, c, g, or t
  misc_feature (149)..(149): n is a, c, g, or t
  misc_feature (151)..(151): n is a, c, g, or t
  misc_feature (153)..(154): n is a, c, g, or t
  misc_feature (161)..(161): n is a, c, g, or t
  misc_feature (214)..(214): n is a, c, g, or t
  misc_feature (216)..(216): n is a, c, g, or t
  misc_feature (221)..(221): n is a, c, g, or t
tctccccaattcctatcagggttacccctgcgtttttctaaatttttttcgcccccccctctatttggggccccccccatttctcccccccttgttgcacaaaaaaaactggcctcccggaacaacccttttgnccccnngnccccttncntnnaccctcnttttctccccccccccaatataatttccccccaggtttttttttttttttttntnttttntttttttttttttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagtctctctgccgtttcttgattcctttccaaacctcagccggggccctggcctcagccccccgtccctgcgtctgctcctcttcacagcagctgctgctggctcctccgcgctcggcgccaggccctgggtcctcagacgcatcactgtcatcagtgtccgagggcagccgggtgctggccacaggcctgttggggtttccaaactctctccctgaatccacatcgaagggatctgagccgagagaggaaagtggcctctaagtgagctcagagcaggaccaggcctcccaccccccaggctttggagggccttggttcccaccccgccaaggctcaccgatctcctcctcctgggggctctccttggcattggccaagaactcctgctccgcctgcagcacctcctccgggctgccgcaggccgcgtacttgtccaggagctggcggttcaggtccaagaagcccttgccccatttaaacttccgcagcaaaatgacagcaaggtctggaaagcctgacggtgtgagaaacaggaaacccaaagaagtcgacggtcccctcaagtgcctcctgatcaccctgctgccggatggcggcgctctcccaagtaaccgcagggtccccagcaaacatcagctcacagtcctgagaacccgtgctgcccccagcctgcacctcccttgctacagtccacacctctgcaaccgaccaagtccccctcctttgctgcgaaacaaacattcccaccaagactgcccca

SEQ ID NO: 406356 - DNA, 4521 bp, Homo sapiens
atgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctca

SEQ ID NO: 406357 - DNA, 4678 bp, Homo sapiens
  misc_feature (87)..(87): n is a, c, g, or t
cgcccagcagttgctcagtcgtcggcgcgcgcggctgggagcggtagctgtgcctcggcgtccccgagctggtgccgagcgcagcgncccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggcctggggctctccctgccgtcagagccctcaccctgggccccacacacaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgggtgcagcgccgcgtgtcagcgtgggtgggggcggctggcagggcaggccccacgtcagcgtgctgcccccacccaggtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctca

SEQ ID NO: 406358 - DNA, 5388 bp, Homo sapiens
  misc_feature (87)..(87): n is a, c, g, or t
cgcccagcagttgctcagtcgtcggcgcgcgcggctgggagcggtagctgtgcctcggcgtccccgagctggtgccgagcgcagcgncccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgggtgcagcgccgcgtgtcagcgtgggtgggggcggctggcagggcaggccccacgtcagcgtgctgcccccacccaggtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagtctctctgccgtttcttgattcctttccaaacctcagccggggccctggcctcagccccccgtccctgcgtctgctcctcttcacagcagctgctgctggctcctccgcgctcggcgccaggccctgggtcctcagacgcatcactgtcatcagtgtccgagggcagccgggtgctggccacaggcctgttggggtttccaaactctctccctgaatccacatcgaagggatctgagccgagagaggaaagtggcctctaagtgagctcagagcaggaccaggcctcccaccccccaggctttggagggccttggttcccaccccgccaaggctcaccgatctcctcctcctgggggctctccttggcattggccaagaactcctgctccgcctgcagcacctcctccgggctgccgcaggccgcgtacttgtccaggagctggcggttcaggtccaagaagcccttgccccatttaaacttccgcagcaaaatgacagcaaggtctggaaagcctgacggtgtgagaaacaggaaacccaaagaagtcgacggtcccctcaagtgcctcctgatcaccctgctgccggatggcggcgctctcccaagtaaccgcagggtccccagcaaacatcagctcacagtcctgagaacccgtgctgcccccagcctgcacctcccttgctacagtccacacctctgcaaccgaccaagtccccctcctttgctgcgaaacaaacattcccaccaagactgcccca

SEQ ID NO: 406359 - DNA, 5219 bp, Homo sapiens
  misc_feature (87)..(87): n is a, c, g, or t
cgcccagcagttgctcagtcgtcggcgcgcgcggctgggagcggtagctgtgcctcggcgtccccgagctggtgccgagcgcagcgncccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccatcgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgggtgcagcgccgcgtgtcagcgtgggtgggggcggctggcagggcaggccccacgtcagcgtgctgcccccacccaggtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagtctctctgccgtttcttgattcctttccaaacctcagccggggccctggcctcagccccccgtccctgcgtctgctcctcttcacagcagctgctgctggctcctccgcgctcggcgccaggccctgggtcctcagacgcatcactgtcatcagtgtccgagggcagccgatctcctcctcctgggggctctccttggcattggccaagaactcctgctccgcctgcagcacctcctccgggctgccgcaggccgcgtacttgtccaggagctggcggttcaggtccaagaagcccttgccccatttaaacttccgcagcaaaatgacagcaaggtctggaaagcctgacggtgtgagaaacaggaaacccaaagaagtcgacggtcccctcaagtgcctcctgatcaccctgctgccggatggcggcgctctcccaagtaaccgcagggtccccagcaaacatcagctcacagtcctgagaacccgtgctgcccccagcctgcacctcccttgctacagtccacacctctgcaaccgaccaagtccccctcctttgctgcgaaacaaacattcccaccaagactgcccca

SEQ ID NO: 406360 - DNA, 10722 bp, Homo sapiens
  misc_feature (1529)..(1529): n is a, c, g, or t
cgccagggtgtcacgggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggagcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcgtcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggacttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccagtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaacatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagagaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatatagg

SEQ ID NO: 406361 - DNA, 770 bp, Homo sapiens
ttaatttcatttatcttgaactaagactccactgtttcatcctcttagatgctgctacttgaacaatattgttttgagaccaaaaactagcatattaacacaattcttcttaaacgtcttaagagttttgtttcctttacccctttctttaaaaacaagcagccactaaattttttagtagtgaatttcaaaatcctttttaaccttataggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggtatcaagactgtgacttttaattgtagtttatccatttttattcagtattccctcttgtaaacttgaggtaagacactttacttaaaagtgtattttaaattaagcaataatatgtaaactctttcttgcaaaagttagcatttatatttttaaataagatatattgaattcattcagtgaatcatataaagaaaataagtgtaaaactccaatggctagttagttcttagttctttttaagattaaagagaagagaccaaatataggcatcactgtactgagggcaaggttttctgtgtagttcataggaaactaggcctcatggattttaggaatatgccttggaatatttaagtgtaggccttcctccccaactccctcagatcttgccaccccttaagtgc

SEQ ID NO: 406362 - DNA, 9616 bp, Homo sapiens
  misc_feature (1529)..(1529): n is a, c, g, or t
cgccagggtgtcacgggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggagcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcgtcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggacttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccagtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaaga

SEQ ID NO: 406363 - DNA, 10801 bp, Homo sapiens
  misc_feature (1608)..(1608): n is a, c, g, or t
gcgggctcaggccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggagcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcgtcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggacttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccagtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaacatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagagaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatatagg

SEQ ID NO: 406364 - DNA, 10656 bp, Homo sapiens
  misc_feature (1529)..(1529): n is a, c, g, or t
cgccagggtgtcacgggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggagcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcgtcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggacttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccagtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaacatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagagaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatatagg

SEQ ID NO: 406365 - DNA, 2789 bp, Homo sapiens
  misc_feature (1529)..(1529): n is a, c, g, or t
  misc_feature (2007)..(2007): n is a, c, g, or t
cgccagggtgtcacgggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggtacctttgaaaacatttagtactataatatgaatttcatgtttggcttttttttgctgccttcttttagccatgagatttcctaatttcttacctgtgtattattcagtactataatatgaatttcatgtttagctttttttgctgccttcttttagccatgagattccctaatttcttttttgagatgggntctctttctctcgcccaggctggagtgcagtggtctgatcttggctcactgcaacctccgtctcccatgttcaagtgattctcctgcctcagcctcctgagtagctgggattacagtgcacgccaccactcccggctatttgtatttttagtagagatggggtttcaccatgttggtaaggctggtctcgaactactcctgactttgtgatctgcccaactcggcctcccaaagtgctgggattataggcgcaagccatcacgcccagcctagattccctaatttcttacctgtttatctcaccagtccatagttttagagtaccgcaaactcctaaagtactaaggtagaaaagattatataaggggatttaatgtatatcagggtttctctgcctcagcactatagacatttttgaccagataattcttcgttttgctggggctgacctgtgcactgtagattgtttagcagcatccctggcctttgccaactggctgccagtataccctccccctagttatgccgatcaaaattgtctccagatactgtcagatgtctgtgggagggaggaaggacaacgtcaccaccaattaagaatcactggtataagtgtacctttgtgctctccaaacctcaatcccctcaaattttgatggtcaacttatcaagaggtgatcagagccaagggtgaggaatcatcaaataataatttgtttacagaaggaaatatctccaggcagtccatctgcttcagaaactaggctaaatttaaaaagaaa

SEQ ID NO: 406366 - DNA, 488 bp, Homo sapiens
aacctaatatttcactttaaaataatataacattaagaatattttagactgcttaaagcaattgttgtataaaaacttgtttctattttatttagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtaacttttcttcatatagtaaacattgccttgtgtactccagtttattgttattttgtaatataatatttaaattgtgaatttatagtaggtgatagctaacacttagagcattttgcatttttaaactcaaagatagcatgttattgattgcacttacattaaatctaaaaatataaacaaggccgttt

SEQ ID NO: 406367 - DNA, 10880 bp, Homo sapiens
  misc_feature (1687)..(1687): n is a, c, g, or t
ttaatttcatttatcttgaactaagactccactgtttcatcctcttagatgctgctacttgaacaatattgttttgagaccaaaaactagcatattaacacaattcttcttaaacgtcttaagagttttgtttcctttacccctttctttaaaaacaagcagccactaaattttttagtagtgaatttcaaaatcctttttaaccttataggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggagcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcgtcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggacttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccagtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaacatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagagaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatatagg

SEQ ID NO: 406368 - DNA, 10505 bp, Homo sapiens
  misc_feature (1529)..(1529): n is a, c, g, or t
cgccagggtgtcacgggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaaaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggagcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcgtcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggacttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccagtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaacatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagagaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatatagg

SEQ ID NO: 406369 - DNA, 4557 bp, Homo sapiens
cgccagggtgtcacgggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaacatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagagaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatatagg

SEQ ID NO: 406370 - DNA, 2094 bp, Homo sapiens
  misc_feature (1529)..(1529): n is a, c, g, or t
cgccagggtgtcacgggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtangggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaagagatggagtcttgctctgctgccaggctggagtgcagtggcaggatctcggctaactgcaacctccaactccctggttcaagcgattatcctgcctcagcctcccaagtagctgggattataggcatgcgccaccatgcccagctagtttttgtatttttagtagagacggggtttcaccatgttggccaggatggtcttcatctcctgacctcatgacccgcctgccttggccttccaaagtgctgggattacaggcatgatataatgcatggtcaatc

SEQ ID NO: 406371 - DNA, 535 bp, Homo sapiens
gagaaggccaaggtgagaggaggcgggaagcatccctgtcccaggagagcctcagattcaaaccctgggcacactttctgctggcggctctgtctgtataaaaacttcccttgtagcctttgagtgttaaggggacaccatgtgcatgaaggtgtctgaaatccagctgctggtttccctttggtgcagcattttcttatctgaatcctagtgtgccattaagaacaggttcatcctttcatctttgaaatatgccagagtccttcctgctgtctatttataggttccctaaactttacaaaatacaggatggcttggagacaatttgaaagtattgcaaggttccaggaatgctgccatttacatacttgagggaccttgaggaattccagcgaaccaggcacacttggtctgcccaagcttttctctgagaggggccctgctcattctgcgttctccttgtgtttatcttctgcacaggcttctgtggtccagtccatatggaagctcttggaacacttctgtgttccactgt

SEQ ID NO: 406372 - DNA, 1084 bp, Homo sapiens
cagcatccttggcagtagggttttaggtggagtctatctggctttcagagaagagtcaggaaaacatttttattcccagcctgtgtcccatgggcaaaagcaaatcccaaattctcctcctgaaccctcccaatttgtctctacaaactctcttctccttgtttttctgttttctcatggctgaccttgtgtctcgcctgagaaaggtagggaggggtcattatcagccctgagccctatgtggtagaagaggcttcacagagggacaagaaggagtgtcctcaagatcaagttgcttctggatgtcactaacacatccccttctgccacgtcttttttttcttgtacctattccatgagctacaaggaacatctgaggctttgaaacaagctcacacttttcccccaaatgagaggaggaagccccttgggtgagggaggagcagctcagactctgcttcctgctctgctctgggctcctctggtgactggccctgtttgactccacctggggtgggaccagcatgtgtggagaaagaccccttgtggactgtcctgaatttcgctaaatggagctgccagttgaagccaagcctcccccgggccaggctgcagggaaatgagaagagaaggagcctcagggcagactcctgagcctggtcctggctctgaagtcagcggttgtatgaagctgtgggcacagtacgtgggacacagcatggaggactgtgactgatgcagagctagagaaatagggagattcacccctggagctctgcatggcaggaaaagggcagtgccaaaaagtgtgtaattatagagagggtaagactaccagacactttatatatatctaatataaggcttaccattagctatttctaagtgtgcaatttagtgttgtgtaaccatcacactatccatttccagaactttttcctcttaccatattaaacctctgtacccaataaacagtaactctcactccttctccctcgaacccttagcacccaccattctaatttctgtctctatgtaactggctattctaactatcttttataaatggaattatataataatt

SEQ ID NO: 406373 - DNA, 695 bp, Homo sapiens
actcagatggcaccactgcactccagtctgggtgacagagtgagactccatctgaaaaaaaaatttttttaatgagtattctaaaaattatatgaaatttctgaaaatcaaatatgttatcatagtgtcatatgccacagaagtaactagatttctatgtgagctgtgtctttaccataataaattctcattagatttttaaccatagtcagtttaaatctctgtcattcccagacagttgctttgattcttcctcaaactacttacaatcacctacagtccaaaattgctttttcttcaaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406374 - DNA, 1644 bp, Homo sapiens
actcagatggcaccactgcactccagtctgggtgacagagtgagactccatctgaaaaaaaaatttttttaatgagtattctaaaaattatatgaaatttctgaaaatcaaatatgttatcatagtgtcatatgccacagaagtaactagatttctatgtgagctgtgtctttaccataataaattctcattagatttttaaccatagtcagtttaaatctctgtcattcccagacagttgctttgattcttcctcaaactacttacaatcacctacagtccaaaattgctttttcttcaaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaaaaaaaaaaaaaaaaaaaaaaaaaaagaaaaaagaacacaagcggggggggcgggggggcgcgcgaagcaagtcgacgcggcgggtgcgggggggggggggggcacgggaggaggagaagcaggagcgaccggagagcaacgccaggaggcaagaggaagggggcaggaggcaacacaaacaaaaacaggaagaagagggagagcggagacgaggagcgaagaacacaacacaagggggagggaggacgagagcgaggcgcgggggacacaataacggagggagcacggagcagcagggaagaggaagcaaagacagccgcgccgcgcggggcgaagcgggcgagagcaagagagagaggagagaagggacgagtcaaggagtagaagaagcgcgcgcgcagcagaagacagggagcagaagagagcaagcccaggagagcagggccaggcccgagaggacgagacgagggaagcgaagagagggcgagacgaaaagcagggaagcgagcagcgggagaggaaagaaagcacaaagcagcaacaacagaagagggcgaacgaagaagatagaacgaagagaaggaaagagaaggagaacagaaggagagaagacgagggagagagaagaggaagaaggaaggaggaggagaggaaggaggaaaggagcgggcagagaggaagaggaagggggaagagaacgaagacgggagaggagaggacgaccgggagcgagggacgagagacgcgcgagagagacgacgaaaagcagcaggcaaagcacgacaacacacacgaccgaggaagcaccaagccacaaaaagacaccacacagccaa

SEQ ID NO: 406375 - DNA, 1581 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406376 - DNA, 1715 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttcaaaaaaaaaaaaaccaaccacacacacaaaacattgttgcgcgcggccgcccgcgaaaatctcttctaaacaactcttgttgggcagcgcccccaacagatttagacacacgtggcaacatacgttcacaagaaa

SEQ ID NO: 406377 - DNA, 1764 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaaatttcatgaaggtatcaacctgttctttttctcagtgtctctattgtggcagccattaatgagactctgtctggtttccatggcagggacctgattgacagaaggcccaggtcagcgcatttcaaattcactacctcctttacagagaaagcttctttcccacaggctcccagcaagggtgtgaaagcaagtctagttctccgaggctctctttaactccaatgggtgactggttggaggattcctcatcagccttgcaaaaactcttagaactgcattggtacctaaaacttctttctctttctttttcacaggaatcagctctgcatagcggtctgtgggttctcccatactaccttcatgcctgccccacattccctcacaggtgtcttccctgataaattatcttgtatgtctaatcccatcttggatgcatctcagttggtaaaaactaacataccagacttgattctttgcacttagctttttttcttt

SEQ ID NO: 406378 - DNA, 2200 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcagagacgtggtctccctttcttgctcaggctggtcttaaactcctggtttcaagtgatcctcctgccttagagtctcaaagtgctgggattacaggcctctgccagcacacctggccccccaattcttcaaaagctttcagagaaagcattgtagaagacatgactttgtgactgtaagtttcatctgatcctacatcactaggaaggctcattcttaagaagtcatgcatggaaaaggggatgaagacaaatcagaaaagggcaaagggaagtcacagcaaaaaagggacagtataatccctggaaccttattaaagtcacacaactgctgcttcaattagagcaattcgtttggcaaacatcgttctaaccctatagactaggttttccagagtttctgaagtatcttccaattgcaatggcaatctgacacatttttctgaattgcagtctgaatccagtgttcatgtgtaccttttgtatagtccacacatcagcagccacaaaggttgtttatatataagttgctatgatttctccagaagtttacataagtcattgagtttcagcttgcaaggtttaatctatccatctgacaaaaggctaatatccaaaatctacaagaaacttaaacaaatttacaagaaaaaaaaaaagcccatcaaaaagtgggtgaagcacatgaacagacacttctcaaaataggacatttttgtgaccaacaatcacatcatggttcatgatgtgatggtccatgatgtgattgtacatgatgtgatggtccatgatgtgattgtccatgatgtgatggtacatgatgtgatggtccatgatgtgattgttccttaaagacatctacatctgccccactttctgtctcacaaacaaccttgccaaagtcatcttctacccctgtcctgcccagggcaagggagactcctgtgattcatttcagacatcacaatgactcattcatgacaatgctccatagtagtcaactgcgacttagagca

SEQ ID NO: 406379 - DNA, 1146 bp, Homo sapiens
gggactacaggcaaacatcaccatgtacagctgtccccagctttctaatctggtctttctcttgccccagaaactaaagaaggcatgaagccagcccctgcagtgccccattcaccctgaatctcctcccgaagctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406380 - DNA, 1072 bp, Homo sapiens
gtgacacgcggtcgatctgactacgcggtcgactgactacgcggctcgatctgactacgcgtggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406381 - DNA, 1577 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttgatgaacaggctgataccttcagtgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttag

SEQ ID NO: 406382 - DNA, 1422 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatgatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406383 - DNA, 871 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccgtgagtatcttctgttcctctg

SEQ ID NO: 406384 - DNA, 595 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagtggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccaagaattcaccttcattacaccaattaccaagtgagatccctacatgtgagagaccctaccatgtgagagacctacatggggagacctacatgtg

SEQ ID NO: 406385 - DNA, 1170 bp, Homo sapiens
gcagaaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagtggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcagactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttgatgaacaggctgataccttcagtgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttag

SEQ ID NO: 406386 - DNA, 462 bp, Homo sapiens
gtctcagagggtcactgtgtccctttaagagaccaggagcatccccttccctcagatggcatcacctgtggctttattctctttgctccagatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctggtaagtggatcccagcatccttggcagtagggttttaggtggagtctatctggctttcagagaagagtcaggaaaacatttttattcccagcctgtgtcccatgggcaaaagcaaa

SEQ ID NO: 406387 - DNA, 405 bp, Homo sapiens
  misc_feature (34)..(34): n is a, c, g, or t
  misc_feature (52)..(52): n is a, c, g, or t
aggctcggtacccgattgactacgcggcttgganatttcaccttcaccttanacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggttcagacctccccagaattcacccttcatacctcaatcaccatcagtatctttccgggacctcaaga

SEQ ID NO: 406388 - DNA, 2530 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaaaaaaaaaaaaaaaaaaaaaaaaaaagaaaaaagaacacaagcggggggggcgggggggcgcgcgaagcaagtcgacgcggcgggtgcgggggggggggggggcacgggaggaggagaagcaggagcgaccggagagcaacgccaggaggcaagaggaagggggcaggaggcaacacaaacaaaaacaggaagaagagggagagcggagacgaggagcgaagaacacaacacaagggggagggaggacgagagcgaggcgcgggggacacaataacggagggagcacggagcagcagggaagaggaagcaaagacagccgcgccgcgcggggcgaagcgggcgagagcaagagagagaggagagaagggacgagtcaaggagtagaagaagcgcgcgcgcagcagaagacagggagcagaagagagcaagcccaggagagcagggccaggcccgagaggacgagacgagggaagcgaagagagggcgagacgaaaagcagggaagcgagcagcgggagaggaaagaaagcacaaagcagcaacaacagaagagggcgaacgaagaagatagaacgaagagaaggaaagagaaggagaacagaaggagagaagacgagggagagagaagaggaagaaggaaggaggaggagaggaaggaggaaaggagcgggcagagaggaagaggaagggggaagagaacgaagacgggagaggagaggacgaccgggagcgagggacgagagacgcgcgagagagacgacgaaaagcagcaggcaaagcacgacaacacacacgaccgaggaagcaccaagccacaaaaagacaccacacagccaa

SEQ ID NO: 406389 - DNA, 2432 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcagagacgtggtctccctttcttgctcaggctggtcttaaactcctggtttcaagtgatcctcctgccttagagtctcaaagtgctgggattacaggcctctgccagcacacctggccccccaattcttcaaaagctttcagagaaagcattgtagaagacatgactttgtgactgtaagtttcatctgatcctacatcactaggaaggctcattcttaagaagtcatgcatggaaaaggggatgaagacaaatcagaaaagggcaaagggaagtcacagcaaaaaagggacagtataatccctggaaccttattaaagtcacacaactgctgcttcaattagagcaattcgtttggcaaacatcgttctaaccctatagactaggttttccagagtttctgaagtatcttccaattgcaatggcaatctgacacatttttctgaattgcagtctgaatccagtgttcatgtgtaccttttgtatagtccacacatcagcagccacaaaggttgtttatatataagttgctatgatttctccagaagtttacataagtcattgagtttcagcttgcaaggtttaatctatccatctgacaaaaggctaatatccaaaatctacaagaaacttaaacaaatttacaagaaaaaaaaaaaaaaaaaaaatttggggggggttgggcccggaaaaggtttttaaaacttcggtggggcgcgcgggggcgccaaaagaagggctacggtgaaccactgtgggccattagcgtgtgttccctaaggagaagactccgggcgcaagagagccaaaggggcgtggggtctctctccccaatataaaaaaccaggccgggggggtacccgagcgcggtttctgagaacaactaccaaaaggggggcttcctaggggcgcacactaagggggtctctatctcacaagagggggctctcaagaggggagccgtggaatatcttcaataaatttaagcccccggctcgtgtggggcttactcccactatcactagccagtccgataaaacaacagcaccgcgagcaaacatcacactaagtactaggcacgcgatccacgaccacgcgaatcaataccaccgaggatctgtcaaccaagcgaggagcagtacagagcacgaccaaactgctagcaccacaaccgcatccagaagcaaacgtacagcggcaaagagcagagcaccaccaacaggaggtgcaaagagagaagcagaccaa

SEQ ID NO: 406390 - DNA, 1788 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggtatgatggccttttctcttatcctggttcctgcagagctgactgccatgcttgggagagggaaaagacttatttgcctgtatctgggactgcatctcctccttcctccactaaactcctgcttctcagcactaattcctgcagttccctttctccctggcctttatgctccctgtaccccactgtcttttagacataattatctccagcctctgctcatttgtttctcagattcaaatgagaaacacaatttcacatggtgaaaccctcttcattatttttaacatctctcaatagtgtaattctctccattcccataaagctcaaccacttctcaaagtattgcttgacttcttgtctccagactttgaaatcttccttgcatatgattgcctcattacctttctaaaatctggttaattgatttaatcaagaatctgcaggggtctactctagcctatttgataagttcacatttcttctatttactaaggcttctcacttcctttacctctacttcctagtataaatcctccatcctaattagaactgtcttcctacacatccctgccccttcacccatatagacataaaattctt

SEQ ID NO: 406391 - DNA, 1066 bp, Homo sapiens
  misc_feature (34)..(34): n is a, c, g, or t
  misc_feature (52)..(52): n is a, c, g, or t
aggctcggtacccgattgactacgcggcttgganatttcaccttcaccttanacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406392 - DNA, 1559 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcatagaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406393 - DNA, 949 bp, Homo sapiens
ttagccttcacctgtgaacctaagagtgagagctacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgatatggtggcatccacagtgacccagtcaccctgaatgtcctctatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttca

SEQ ID NO: 406394 - DNA, 990 bp, Homo sapiens
atgagcctgggaattgctgctgccccgggaagaggctcagggcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagctactcaggaggctgcggcaggagaatcacgtgaacccaggaggcagaagttgcagcgtgccgagatagcgccactgcataccagcctgggcgacagtacgagactccgtctcaaaaaaaaaaaaaaaaaaaaaaaaaaaagagaaaaaagaaataaaaggaaagaaggctctgttggagcctggataggggaaaatataccagagagggacaggggtcaaaacaggaaagtcacattgaactggaattggtaagaggtaggaaaatcttaagtgttctgttttcctgattaatcatcaggggccacattttgaaaaatgataataataactatatcagatgacacttcaaataaaaatataagcaggacgtgaaacactgtcctcagcaaaaaacctcaacaattgggggagaaaaaaaaaacaccaagggtgtggagggccctgagaagtctcacatctacaggagtctgcagcctgttccaggcactggggtgcaaccaagatcacaaaagtccctgtcctcactgagctcatgctgtcatggggaggaagacagaggtcaaaacaggagaggcagagtggagagggcagaaagacaatctttgaagaccatcagccaactgccttaggaggcttaggagagtccataggaagtctaatgtccccagaagcagaaacagaagacagaagatgtacctggtagcagcttgtccacagggatctgatgtaacggtgttttctcatggaagcaaattaataataaatgctgtttgtgtgaaacctc

SEQ ID NO: 406395 - DNA, 563 bp, Homo sapiens
catcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttataccgtaagtgattccacatgatccctgggtgttgggggacaggggtcatttctacttcacacacacaggattgtcaggcctagactgtgcctgtgtccctctctgcattatgtcccatgctggggtttgggcatttagtgcaggacacacacagaggagacacatttcaacagatcagaattcctttcccgcatccagac

SEQ ID NO: 406396 - DNA, 391 bp, Homo sapiens
ttttggactcggattgggcctgtgtcccagttgtgttatttttcagggaaaatcttccctttggattgagaaagcttacccagtgcctgtgccatcactgtaacttgaaagaaaagaattgtcttttacattcagggactcataggcagaagagattgcagccttgtcttggatgagacttgaacttactacatttgagttactgctggaatgagttaagacttttggaaacttttgaaaaggcatgtttgtatttttctgtgtgagaaggacatgagatgtcagcccccaaagaaatgggggtgcatgctgggcctggccccctggcccacccccactttccagggcaaaaagggcccagggttataataagtaaataacttgtctgtac

SEQ ID NO: 406397 - DNA, 853 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcaggtactgtgcgatctgggggcgcggcgcctcggctaccctcctcgtgttgtcttccacgctataatgcatggaatataatatatattatatggaatataatatatggaatataatatatataattatagcgttgtcttccacgctataatttatgtcgtcctcggtctctttatgtcaccattcctctccttctgtctcatcccacttaaatcctcacaactccttctgtcgccatcacccatgtcaccctcggccgggtgcggtggctcatgcctgtaatcccagcactttaggaggccaaggtgggcggatcacctgatgtcgggagttcgagaccagcctgatcaacatggagaaaccccgtctctactaaaaatacaaaattagccgggcgtggtggtgcatgcctataatcccagctactcgggaggctgaggcaggagaatggcttgaaccggggaggtggaggttgcagtgagccgagatcgcgccattgcactccagcctgggcaacaagagcgagactccgtctc

SEQ ID NO: 406398 - DNA, 1256 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgctccaggggaaccttcacccaacaaggcgggtgggctgcgcagggcgcaaggctggacatcgctctgtaatgaacacccaaatgaccacacgagagcctgcggcggacgaggcccgcaagacaccgagacagggcgagacgaggccagagactcgcacagaaggggaagcgtagcccacacggcgaaaacgcgccaggcgc

SEQ ID NO: 406399 - DNA, 790 bp, Homo sapiens
ggcgcgctgggagccccatggaggttctagggtcctgagaatacaggcattgagacgggctgaggaggaactccagcatccggctgcccgtgcccaccttcagtttcaccctaccctgctcccacaaggatctgagcagggagggggcctgatttccttctcccgctgagaccacagtcctctggaggctaggatctggtgatggggcaccctagctaggagcctgagcctctttataatttagtttccatagaagttatatgtgcatttaaaaaaattcaatgtaagtaaagacctacaatgaaaagcaaccgtcttgtctctgggggtgggatgggggatgcctttgcgtggggagctgttaggagacttgacagtcacctttgctgagagcctcctgcatgtcaggggctcttctatgcacattatatgtgtgctaattccttttttaaaactttactttttgtggagatgagtcctgctgtgttgtgtaggctggtcttgaactcctggcctcacgcaatccacccccaaccttagcctcccggagtgcagggattacaggtgtgagccacctttcccagcctgttgactcctttaattcagaggagtcagtcagattttagacatctcaaatgttgtatgttcaaaaccaaactcctggtcttttccccaaacttgtgtctccctgtcttgcccaatcagctgttgacacctccaatccttgcagttgctgcggccaaaactcagtcatccctcactcctttactgctctcaaacccacatccag

SEQ ID NO: 406400 - DNA, 2438 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406401 - DNA, 1970 bp, Homo sapiens
  misc_feature (36)..(36): n is a, c, g, or t
cccacgcgtcgcggacgcgtgggtcgacccacgcgntcctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406402 - DNA, 2473 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406403 - DNA, 1948 bp, Homo sapiens
  misc_feature (36)..(36): n is a, c, g, or t
cccacgcgtcgcggacgcgtgggtcgacccacgcgntcggtcaggcggggatacagcctggaagaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406404 - DNA, 1631 bp, Homo sapiens
cccgtaagcctggtctgggtccagcaggacccagcggagctttcttttccgcagccttccacgcctcaatctccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406405 - DNA, 2618 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcgctggggctggggctggtctgggcctgggggtacccagcctggcccctgatctctgcccctgctggtcacaggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406406 - DNA, 2399 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacagctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406407 - DNA, 2955 bp, Homo sapiens
  misc_feature (2644)..(2644): n is a, c, g, or t
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacaaaaaaaaaagaaagaaaaaaagaaaaaaaaaaaaaaaaaaaaaaaaaaaaaaaaaaaaaaagaaaaaaaaaggaggggcggcggacgaaatagatgatctacctcaaaccatgggcgcgcggaacacagacaaaagagaccagtctcacgcagatagtatatgttgatgacaacagagcggaagtctgcacactctagtatgtgngttgattgtatatatatattatacagtaaagaaagagacgaggacgacgagtcgcgattattttaaacagacaaaggatgatttggatgtaggagatacagacgatgatcagacatgaatgcgaatcacttctatcgatcggtgtagacgatagaaccaccacatttactctagatgagataggaggtagcaaagagacataactttagtgaaaggatacagaaaacgaaaatacgtctagcatagaagaaagatatgtatatactatgatagctagacgaatcatgcgatgagatacagtatatacataa

SEQ ID NO: 406408 - DNA, 2368 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406409 - DNA, 2240 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggatggccagtggctcagcagaggccccgagatgctctccttcctcccagctgctgccccggca

SEQ ID NO: 406410 - DNA, 2207 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406411 - DNA, 2163 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgaggcccaggctcgaatcccatatgcccgtgtcaaccacaacaagtacatggtgactgaacgcgccacctacatcgacctcccactgtctggcaacctactaagcggaacagcgg

SEQ ID NO: 406412 - DNA, 2168 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacagctacgagcgtggcgtcaaggtgcgcctgctcatcagctgctggggacactcggagccatccatgcgggccttcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406413 - DNA, 846 bp, Homo sapiens
ggctgcggcgggccacagcccatcgtcaatggcaggccagaacctgtgagggtgggagaactccagagtgggcaggtagttgttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406414 - DNA, 834 bp, Homo sapiens
ccattcatgcgcgtcactaattagatgacgaggcatttggctagggtttcgatgaccccgcatcggcgtgttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406415 - DNA, 2032 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406416 - DNA, 1354 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatcagcccccaaagaaatgggggtgcatgctgggcctggccccctggcccacccccactttccagggcaaaaagggcccagggttataataagtaaataacttgtctgtac

SEQ ID NO: 406417 - DNA, 1601 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccactggggctggggctggtctgggcctgggggtacccagcctggcccctgatctctgcccctgctggtcacaggtgcccaggtccgcatggtggacatgcagaagctgacccatggcgtcctgcataccaagttctgggtggtggaccagacccacttctacctgggcagtgccaacatggactggcgttcactgacccaggtctgtctgcaccctgtctaccttccttccaggccactccctgccccacagggcacccagcctccgactgcatccctcactcaatccagagtcctctccacccattctctgtaatggcttccttcttgcctcctaccaggcctccctaatccaagccatgcacggtggctcacacctataatctcaacactttgggaggccaaggtgggaggattgcttgagcccaggagttggagaccagcc

SEQ ID NO: 406418 - DNA, 1199 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctcgttcctgagttagcagctcgcccctgagttagcagctcgcccctgagttagctgctcgcccctgagttagcagctcgcccctgagtgagctg

SEQ ID NO: 406419 - DNA, 224 bp, Homo sapiens
tgtcttccacgctataatttatgtcgtcctcggtctctttatgtcaccattcctctccttctgtctcatcccacttaaatcctcacaactccttctgtcgccatcaccctctttaaatcctcacaactcctcttgttgtcatcaacgcccttaactcgctttcgttccctgtaagccctctttgccaccataggtcgtaatcgctccctttaaattcgtcatcg

SEQ ID NO: 406420 - DNA, 2348 bp, Homo sapiens
ggcgcgctgggagccccatggaggttctagggtcctgagaatacaggcattgagacgggctgaggaggaactccagcatccggctgcccgtgcccaccttcagtttcaccctaccctgctcccacaaggatctgagcagggagggggcctgatttccttctcccgctgagaccacagtcctctggaggctaggatctggtgatggggcaccctagctaggagcctgagcctctttataatttagtttccatagaagttatatgtgcatttaaaaaaattcaatcaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406421 - DNA, 2303 bp, Homo sapiens
aattacgctaggtacgagcttcgttgaaatcggccgagggtggggctgggtctcggatgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406422 - DNA, 2169 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406423 - DNA, 2249 bp, Homo sapiens
aattacgctaggtacgagcttcgttgaaatcggccgagggtggggctgggtctcggatgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406424 - DNA, 2861 bp, Homo sapiens
  misc_feature (2459)..(2459): n is a, c, g, or t
  misc_feature (2462)..(2462): n is a, c, g, or t
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacaaaaaaaacaacaaaaacaanaanacaaatcaaaaacaacaacaacacaacaaaaacacaaataacaaaacaaacaaaaacaataagaacactacacccaccatctaaataaaataattcccccacaatgacgcaacaacacatcataacataccaaacaccacacatttatttctaattacccagtagcagggaccccgcaaaaaaacgacagtcagacacaggacaagacagacacacaagcgacgaagaaacaaaaagagcgcaagacgtaaacgaagggtaagaagacaagacgattcttacgaaagacgaacggagacgaagaagaaagactcaatagacccgacaagtgaggcgaacgttcagtgtcgagacaatagaggacagccaccgctaaacaatagaagcgagaaaggagat

SEQ ID NO: 406425 - DNA, 2577 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacaaaaaaaaaaaaaaacccgaggggggggcccgggaccccaatttcccctttggaggagcgttttacaattcacttggcccgcttttttaaaacctttgtgaattgggaaaacccttggttttaccacaattaaattggc

SEQ ID NO: 406426 - DNA, 2464 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccactggggctggggctggtctgggcctgggggtacccagcctggcccctgatctctgcccctgctggtcacaggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406427 - DNA, 1854 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagaggtgctggtggaaggcattccatggggtcctgaatacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406428 - DNA, 2171 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcgacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406429 - DNA, 2126 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcgcctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406430 - DNA, 2084 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggggctattcgcgtggctcgttgtgtggctcttcgtggggcacgtggagttttgacctgctccgtttccgacctgggccactgtcttcacggtgctccctcactgcgccaccccaggtgccacaccaagagccggtaccgagcttg

SEQ ID NO: 406431 - DNA, 928 bp, Homo sapiens
aattacgctaggtacgagcttcgttgaaatcggccgagggtggggctgggtctcggatgggagacgtggagtgcaggtaatgcatgtccatggtacacaaattcacaaggtttgtaaatgagaaaagacgtgaggttccttttgttctttacctgtggcctccgttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406432 - DNA, 883 bp, Homo sapiens
  misc_feature (61)..(61): n is a, c, g, or t
  misc_feature (119)..(119): n is a, c, g, or t
  misc_feature (172)..(172): n is a, c, g, or t
  misc_feature (174)..(174): n is a, c, g, or t
attaggcgcgtctgcgtggggccatgggtgagacactccagtactgagacctagagtccanatgcttgtaggagccaagtcgtgttctaagtatttatttaaaacaaaagaatcacgtnttcccatttgtacttcagcgctagcccctgttttgcacagccgagtactggcnantatgttctatgttgggcctcctgctgcaaaacaataaacagaggacgcagaacgcgcctaatattaggcgcgttctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406433 - DNA, 1090 bp, Homo sapiens
aattacgctaggtacgagcttcgttgaaatcggccgagggtggggctgggtctcggatgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggacccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406434 - DNA, 848 bp, Homo sapiens
aactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccagcggaggtagcagcagacgcctgagagcgaggccgaggcccctcagggtttggagaccctgacacacccaccttctcacctgggctctgcgtatcccccagccttgagggaagatgaagccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtac

SEQ ID NO: 406435 - DNA, 1728 bp, Homo sapiens
cagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcgcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagatggtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggat

SEQ ID NO: 406436 - DNA, 2034 bp, Homo sapiens
cagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagatggtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggctggttatgaagaagaaactcaaaataacaggagtggcttatggaactacatggaggtaacagaggagggtaccaaccaaaggcccttgagcaatcaggatgttgggtaacagatttttgcttttaaatgactcctgggtggagcttccccaatgcatcgtcattccctgacccttgcatctgaccctgtgggtgggaccctccgcctccaccatccactcaaggctcacccctggctcctccaccacccggctcctgccccacacccccgatggcctttcctcccctgtaaggcgactgaggtgactcaggtcaccctgctccttcctcgtctcatctcgtccctcctttcctgcttagactgtgccagatgacccttcttgcaaaggggtgggcgggaaggccccccatgcagccaggcagtgcctggatttgtaactggccatcccagcagcagtgccctggatggaaagccacgtccctgtcaccctctcaca

SEQ ID NO: 406437 - DNA, 987 bp, Homo sapiens
cagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggtgagtctcctggcggcctctccgacacacggaccgtgtgcactgcggctctgcctgtttgtctgtctctgtctgtctctctgatggctgggggctgtgattggaactctggcaaatctggcttcagagc

SEQ ID NO: 406438 - DNA, 1678 bp, Homo sapiens
cagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagatggtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggat

SEQ ID NO: 406439 - DNA, 1515 bp, Homo sapiens
cagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagatggtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggat

SEQ ID NO: 406440 - DNA, 606 bp, Homo sapiens
  misc_feature (174)..(174): n is a, c, g, or t
gggtggtttggttccaccaataaataaattttctatttctatactaagctcatcctttggaacatcatcttcatctccagattcttctccaagcttcttccaccagggtgcttgtatgtgcttcagggttgtgagatgggcctgcttggccttggctgccacaggcctggatcnacttaggaagagctcaggttctttccccctcgtgccgaattcggcacgagggaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaa

SEQ ID NO: 406441 - DNA, 1738 bp, Homo sapiens
cggtatcgccacttggagaccaccgcgaatgaagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaatttcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaa

SEQ ID NO: 406442 - DNA, 1346 bp, Homo sapiens
gagaacagtgttttcttccggaaaagaaacgggggctgtgacaggctccctgtggtgaagccgactaaaaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaatttcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaa

SEQ ID NO: 406443 - DNA, 1495 bp, Homo sapiens
cggtatcgccacttggagaccaccgcgaatgaagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacggtcttctgagatggccccagtgaaccagcttctagatgacatagaatgacatgtaatgctaaatttcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaa

SEQ ID NO: 406444 - DNA, 1718 bp, Homo sapiens
taacgctaggtacgaggctgggtggtgctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaatttcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaa

SEQ ID NO: 406445 - DNA, 1189 bp, Homo sapiens
cggtatcgccacttggagaccaccgcgaatgaagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagcaaccataatgctgcttcttgtgcatgtctgctctgatatacgtcgaacaatgtagcagccactgtcatttctcagtggttttgcctaaccaaacttcttcctaaggagatttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaa

SEQ ID NO: 406446 - DNA, 1838 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgcc

SEQ ID NO: 406447 - DNA, 1465 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttgcagacacgttcattccagcagtgcatcagtatctgtgggctttgtcagcacattctcatagctcccataggtgctgggtccacttgtccaccagcattcaaccacccagcacatgggacagcacaagccagcacactgcccatctcaacacagcatagtatcgtcccacaacgctttggtgccaagcttgcaatgcccagcatcaacaagcccatccacttccgcatcagcgccagggtccaagtcatagggtaggtatccagcgggcatattcacatcacccacatatcaacagcattttcttgaggcatacccacaccacacacacaccagcaacgcagcacaggcatctcaccacacagggtagggccaggcaaactagggtggacaggcaccattaggtcaagaatagcgtggcggctatggcagtaggctcatgccggcccagccatccgtcgcacagggaatcgcaacatcggagcgggggcaaccgcacaggccggcagggcatcaccaaggccatgtcgcggcacaacgaaccacgcgggcacagcaaagtcggaatccacggctccacacacgtcccaccacacgcgcatagctcgccatccgcaagccctgcaacacaggcaagagcaccaggcattccggcaatccaacgcacatggctcccatggggaaacacgacatgcacccggcctacgcaccccgggcactcggcgctcgcacgatacctacacggcctcccgcacggcgtggctgggaaccagcttcgggcagacaaaacaccctacgaacacgcccacacacagttagggagcacggccacgccacacacaccacaccacaggtacaacacacgcagccagcacacgaaacaacgggacacacccaggagcaacacgttcgcgacccgatcttgggtctgagcttgcaaccacacacggcgccaacacacagccgcgacgtcatcatggggagcagactcacaccgaagcacacacgggaccccaccgaaccgagcacgtctccccaacccaacacccgtcggcgcaagcaaactcacaaccagggcgcgcagatcaactccgatgccagcagtacaccagctggcgcgacgcaccaactccaagcaaccaccaaccccgccgcgaccacacctacaatcagggtagcaccgagacacgtcgcccaacccaatcagcacgacgggacacatctacatccca

SEQ ID NO: 406448 - DNA, 2316 bp, Homo sapiens
ccctttatatgctctaggccctgtacaaactgtacggtaactggccccgggattttattgcgcctcccgattttatacgggttgcagtactccgggctcggcatggctctcctgggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406449 - DNA, 2189 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406450 - DNA, 2056 bp, Homo sapiens
tttaatgcagttgctgctttaaaagattaacaacatcttttaatgcagttgctgctttaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406451 - DNA, 2192 bp, Homo sapiens
gccagaaatcactcgaacccgggaggcggaggttgcagtgacctgagatggtgccactgtactccagcctgggcaacagggtgagactccatctcaaaaaataataataataaataaaaaaggaaaaggaattggttttccaagtgttaagtttagtgcaaaatgcattgtggggagaaagtgtgttctgtcagagatacacgtgtcagaactgtgtcacacctggtgaagccgacagtgaggtaaagacacagtcttgggccgggccagatgaggcacttgctgaaggccgggctgaggaccgcctaccttccgtctcctgtaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406452 - DNA, 2277 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa
